United States Patent 9,580,736 (ANALYSIS OF NUCLEIC ACIDS ASSOCIATED WITH SINGLE CELLS USING NUCLEIC ACID BARCODES) - sequence listing, part 2

SEQ ID NO: 29842 - DNA, 16 bp, Artificial Sequence
  synthetic [barcode part1]
acgtaatagtcggagt

SEQ ID NO: 29843 - DNA, 16 bp, Artificial Sequence
  synthetic [barcode part1]
atcgatctgtgcgtag

SEQ ID NO: 29844 - DNA, 16 bp, Artificial Sequence
  synthetic [barcode part1]
tcttggacctgtccag

SEQ ID NO: 29845 - DNA, 16 bp, Artificial Sequence
  synthetic [barcode part1]
accgcaatactcgcct

SEQ ID NO: 29846 - DNA, 16 bp, Artificial Sequence
  synthetic [barcode part1]
gagattcacaggtggc

SEQ ID NO: 29847 - DNA, 16 bp, Artificial Sequence
  synthetic [barcode part1]
tctagaaggccaacct

SEQ ID NO: 29848 - DNA, 16 bp, Artificial Sequence
  synthetic [barcode part1]
ataccaccaagatccg

SEQ ID NO: 29849 - DNA, 16 bp, Artificial Sequence
  synthetic [barcode part1]
agacacttcacgagtc

SEQ ID NO: 29850 - DNA, 16 bp, Artificial Sequence
  synthetic [barcode part1]
ttccggttgtatcaac

SEQ ID NO: 29851 - DNA, 16 bp, Artificial Sequence
  synthetic [barcode part1]
cctgagatcaaccagt

SEQ ID NO: 29852 - DNA, 16 bp, Artificial Sequence
  synthetic [barcode part1]
ccgtaaggcagttact

SEQ ID NO: 29853 - DNA, 16 bp, Artificial Sequence
  synthetic [barcode part1]
ccaccgattcctgtag

SEQ ID NO: 29854 - DNA, 16 bp, Artificial Sequence
  synthetic [barcode part1]
cgagacctaactgatc

SEQ ID NO: 29855 - DNA, 16 bp, Artificial Sequence
  synthetic [barcode part1]
atcctgtatccgaact

SEQ ID NO: 29856 - DNA, 16 bp, Artificial Sequence
  synthetic [barcode part1]
aacaggagtgcgacct

SEQ ID NO: 29857 - DNA, 16 bp, Artificial Sequence
  synthetic [barcode part1]
aacttatcgcctggag

SEQ ID NO: 29858 - DNA, 16 bp, Artificial Sequence
  synthetic [barcode part1]
gttctgtggcacgtct

SEQ ID NO: 29859 - DNA, 16 bp, Artificial Sequence
  synthetic [barcode part1]
aggtctatacttcacc

SEQ ID NO: 29860 - DNA, 16 bp, Artificial Sequence
  synthetic [barcode part1]
gaaccaggcactaacg

SEQ ID NO: 29861 - DNA, 16 bp, Artificial Sequence
  synthetic [barcode part1]
gcgtgcacagttaatc

SEQ ID NO: 29862 - DNA, 16 bp, Artificial Sequence
  synthetic [barcode part1]
gttggcctataacgtg

SEQ ID NO: 29863 - DNA, 16 bp, Artificial Sequence
  synthetic [barcode part1]
aatccggactgagtct

SEQ ID NO: 29864 - DNA, 16 bp, Artificial Sequence
  synthetic [barcode part1]
aaggtcgtctcgttag

SEQ ID NO: 29865 - DNA, 16 bp, Artificial Sequence
  synthetic [barcode part1]
atagtactggtgccgt

SEQ ID NO: 29866 - DNA, 16 bp, Artificial Sequence
  synthetic [barcode part1]
accgtctatccgcaac

SEQ ID NO: 29867 - DNA, 16 bp, Artificial Sequence
  synthetic [barcode part1]
tctctccagtctcagt

SEQ ID NO: 29868 - DNA, 16 bp, Artificial Sequence
  synthetic [barcode part1]
cgtatctgagtgcagt

SEQ ID NO: 29869 - DNA, 16 bp, Artificial Sequence
  synthetic [barcode part1]
gtgaacgcaagtagag

SEQ ID NO: 29870 - DNA, 16 bp, Artificial Sequence
  synthetic [barcode part1]
gcgttggtggtagaac

SEQ ID NO: 29871 - DNA, 16 bp, Artificial Sequence
  synthetic [barcode part1]
tcctcaagaccaaggt

SEQ ID NO: 29872 - DNA, 16 bp, Artificial Sequence
  synthetic [barcode part1]
aggcgttacaagtcct

SEQ ID NO: 29873 - DNA, 16 bp, Artificial Sequence
  synthetic [barcode part1]
tatctctgttagaccg

SEQ ID NO: 29874 - DNA, 16 bp, Artificial Sequence
  synthetic [barcode part1]
caatctcgtcgatact

SEQ ID NO: 29875 - DNA, 16 bp, Artificial Sequence
  synthetic [barcode part1]
cgagacttgcaacact

SEQ ID NO: 29876 - DNA, 16 bp, Artificial Sequence
  synthetic [barcode part1]
caccgttcgagtctac

SEQ ID NO: 29877 - DNA, 16 bp, Artificial Sequence
  synthetic [barcode part1]
gtaatcgactgacacc

SEQ ID NO: 29878 - DNA, 16 bp, Artificial Sequence
  synthetic [barcode part1]
tagtctggtggttcag

SEQ ID NO: 29879 - DNA, 16 bp, Artificial Sequence
  synthetic [barcode part1]
aactgaacgaggaacg

SEQ ID NO: 29880 - DNA, 16 bp, Artificial Sequence
  synthetic [barcode part1]
gactcggaggaatacc

SEQ ID NO: 29881 - DNA, 16 bp, Artificial Sequence
  synthetic [barcode part1]
tgtggcctggtagaag

SEQ ID NO: 29882 - DNA, 16 bp, Artificial Sequence
  synthetic [barcode part1]
attagatcggaccacc

SEQ ID NO: 29883 - DNA, 16 bp, Artificial Sequence
  synthetic [barcode part1]
taacgcacgacgagac

SEQ ID NO: 29884 - DNA, 16 bp, Artificial Sequence
  synthetic [barcode part1]
ttaggtggacggagtc

SEQ ID NO: 29885 - DNA, 16 bp, Artificial Sequence
  synthetic [barcode part1]
gtcaggcaacacgaac

SEQ ID NO: 29886 - DNA, 16 bp, Artificial Sequence
  synthetic [barcode part1]
tacggatccacagatc

SEQ ID NO: 29887 - DNA, 16 bp, Artificial Sequence
  synthetic [barcode part1]
taacggtgtcgaactc

SEQ ID NO: 29888 - DNA, 16 bp, Artificial Sequence
  synthetic [barcode part1]
atcgaggtataaccag

SEQ ID NO: 29889 - DNA, 16 bp, Artificial Sequence
  synthetic [barcode part1]
gaagttctcgttcgcc

SEQ ID NO: 29890 - DNA, 16 bp, Artificial Sequence
  synthetic [barcode part1]
tcggcgataagagtgc

SEQ ID NO: 29891 - DNA, 16 bp, Artificial Sequence
  synthetic [barcode part1]
gagtaggcgaatagac

SEQ ID NO: 29892 - DNA, 16 bp, Artificial Sequence
  synthetic [barcode part1]
caatcgatcttgaggc

SEQ ID NO: 29893 - DNA, 16 bp, Artificial Sequence
  synthetic [barcode part1]
gaggcgagtcttatct

SEQ ID NO: 29894 - DNA, 16 bp, Artificial Sequence
  synthetic [barcode part1]
gtcacaacacttatcc

SEQ ID NO: 29895 - DNA, 16 bp, Artificial Sequence
  synthetic [barcode part1]
aaccgatcaaccgatc

SEQ ID NO: 29896 - DNA, 16 bp, Artificial Sequence
  synthetic [barcode part1]
acctagtaactcggtg

SEQ ID NO: 29897 - DNA, 16 bp, Artificial Sequence
  synthetic [barcode part1]
tcgtactccacgtctt

SEQ ID NO: 29898 - DNA, 16 bp, Artificial Sequence
  synthetic [barcode part1]
gatctggcgtgtctct

SEQ ID NO: 29899 - DNA, 16 bp, Artificial Sequence
  synthetic [barcode part1]
ccgcgtcttactgaac

SEQ ID NO: 29900 - DNA, 16 bp, Artificial Sequence
  synthetic [barcode part1]
aactccagtaagtgag

SEQ ID NO: 29901 - DNA, 16 bp, Artificial Sequence
  synthetic [barcode part1]
cgtagacttgtggact

SEQ ID NO: 29902 - DNA, 16 bp, Artificial Sequence
  synthetic [barcode part1]
tatcaagtccggtggt

SEQ ID NO: 29903 - DNA, 16 bp, Artificial Sequence
  synthetic [barcode part1]
gccactctagacgtct

SEQ ID NO: 29904 - DNA, 16 bp, Artificial Sequence
  synthetic [barcode part1]
gtcgcagtagataggc

SEQ ID NO: 29905 - DNA, 16 bp, Artificial Sequence
  synthetic [barcode part1]
cctctgagtgtgtcac

SEQ ID NO: 29906 - DNA, 16 bp, Artificial Sequence
  synthetic [barcode part1]
gtacttccttcgcact

SEQ ID NO: 29907 - DNA, 16 bp, Artificial Sequence
  synthetic [barcode part1]
agaactcgtggtgttc

SEQ ID NO: 29908 - DNA, 16 bp, Artificial Sequence
  synthetic [barcode part1]
gactaacactaaccgc

SEQ ID NO: 29909 - DNA, 16 bp, Artificial Sequence
  synthetic [barcode part1]
gtggaacacagacctg

SEQ ID NO: 29910 - DNA, 16 bp, Artificial Sequence
  synthetic [barcode part1]
ccaactcctgtgtgac

SEQ ID NO: 29911 - DNA, 16 bp, Artificial Sequence
  synthetic [barcode part1]
gagaggtacgaagtac

SEQ ID NO: 29912 - DNA, 16 bp, Artificial Sequence
  synthetic [barcode part1]
gaccggtcaatactac

SEQ ID NO: 29913 - DNA, 16 bp, Artificial Sequence
  synthetic [barcode part1]
tctaggtgagtcggag

SEQ ID NO: 29914 - DNA, 16 bp, Artificial Sequence
  synthetic [barcode part1]
gttgtggttgcaacgt

SEQ ID NO: 29915 - DNA, 16 bp, Artificial Sequence
  synthetic [barcode part1]
cgacgtatacgagtct

SEQ ID NO: 29916 - DNA, 16 bp, Artificial Sequence
  synthetic [barcode part1]
acactaggtacagtcc

SEQ ID NO: 29917 - DNA, 16 bp, Artificial Sequence
  synthetic [barcode part1]
ttggatcaagagtgtg

SEQ ID NO: 29918 - DNA, 16 bp, Artificial Sequence
  synthetic [barcode part1]
tgtcctagtctgcggt

SEQ ID NO: 29919 - DNA, 16 bp, Artificial Sequence
  synthetic [barcode part1]
tatactcacctagtgc

SEQ ID NO: 29920 - DNA, 16 bp, Artificial Sequence
  synthetic [barcode part1]
ttctccggaacacctg

SEQ ID NO: 29921 - DNA, 16 bp, Artificial Sequence
  synthetic [barcode part1]
tgcctgtgtctattcc

SEQ ID NO: 29922 - DNA, 16 bp, Artificial Sequence
  synthetic [barcode part1]
tgaggttcgtaacacc

SEQ ID NO: 29923 - DNA, 16 bp, Artificial Sequence
  synthetic [barcode part1]
cgtctaatacagaccg

SEQ ID NO: 29924 - DNA, 16 bp, Artificial Sequence
  synthetic [barcode part1]
cagaaggtgattgtac

SEQ ID NO: 29925 - DNA, 16 bp, Artificial Sequence
  synthetic [barcode part1]
acaatagaggccagag

SEQ ID NO: 29926 - DNA, 16 bp, Artificial Sequence
  synthetic [barcode part1]
ataatcgaaccgaggt

SEQ ID NO: 29927 - DNA, 16 bp, Artificial Sequence
  synthetic [barcode part1]
ataccagttgacgcac

SEQ ID NO: 29928 - DNA, 16 bp, Artificial Sequence
  synthetic [barcode part1]
gttagtacggacctgt

SEQ ID NO: 29929 - DNA, 16 bp, Artificial Sequence
  synthetic [barcode part1]
cgttcacgtaagtgac

SEQ ID NO: 29930 - DNA, 16 bp, Artificial Sequence
  synthetic [barcode part1]
tgtccgcgatattact

SEQ ID NO: 29931 - DNA, 16 bp, Artificial Sequence
  synthetic [barcode part1]
aactgcgtagttgcgt

SEQ ID NO: 29932 - DNA, 16 bp, Artificial Sequence
  synthetic [barcode part1]
tctattgcacgaactc

SEQ ID NO: 29933 - DNA, 16 bp, Artificial Sequence
  synthetic [barcode part1]
cgtaacgcaagatcct

SEQ ID NO: 29934 - DNA, 16 bp, Artificial Sequence
  synthetic [barcode part1]
gaggtcaagaacagtg

SEQ ID NO: 29935 - DNA, 16 bp, Artificial Sequence
  synthetic [barcode part1]
gtacgacaccgatact

SEQ ID NO: 29936 - DNA, 16 bp, Artificial Sequence
  synthetic [barcode part1]
attgcaaccgtctact

SEQ ID NO: 29937 - DNA, 16 bp, Artificial Sequence
  synthetic [barcode part1]
atatactcaagaggcg

SEQ ID NO: 29938 - DNA, 16 bp, Artificial Sequence
  synthetic [barcode part1]
gccggtaggattgaac

SEQ ID NO: 29939 - DNA, 16 bp, Artificial Sequence
  synthetic [barcode part1]
gagtgtgtggtgactg

SEQ ID NO: 29940 - DNA, 16 bp, Artificial Sequence
  synthetic [barcode part1]
tcaagacctcgagatc

SEQ ID NO: 29941 - DNA, 16 bp, Artificial Sequence
  synthetic [barcode part1]
gtaggacagtagaacg

SEQ ID NO: 29942 - DNA, 16 bp, Artificial Sequence
  synthetic [barcode part1]
ttgtggacaccttgcc

SEQ ID NO: 29943 - DNA, 16 bp, Artificial Sequence
  synthetic [barcode part1]
gttcagttggtagtcg

SEQ ID NO: 29944 - DNA, 16 bp, Artificial Sequence
  synthetic [barcode part1]
tgaaggaccttccagt

SEQ ID NO: 29945 - DNA, 16 bp, Artificial Sequence
  synthetic [barcode part1]
tcagtccaggtgttcc

SEQ ID NO: 29946 - DNA, 16 bp, Artificial Sequence
  synthetic [barcode part1]
tcctgaatcacgacag

SEQ ID NO: 29947 - DNA, 16 bp, Artificial Sequence
  synthetic [barcode part1]
gtcggatattcctact

SEQ ID NO: 29948 - DNA, 16 bp, Artificial Sequence
  synthetic [barcode part1]
gcagtaccacaacact

SEQ ID NO: 29949 - DNA, 16 bp, Artificial Sequence
  synthetic [barcode part1]
ttggttcctcagtcct

SEQ ID NO: 29950 - DNA, 16 bp, Artificial Sequence
  synthetic [barcode part1]
gatacgccgtgattgt

SEQ ID NO: 29951 - DNA, 16 bp, Artificial Sequence
  synthetic [barcode part1]
tactgcaactggtcag

SEQ ID NO: 29952 - DNA, 16 bp, Artificial Sequence
  synthetic [barcode part1]
gaaggaatctcggaag

SEQ ID NO: 29953 - DNA, 16 bp, Artificial Sequence
  synthetic [barcode part1]
aagacaagatactcgc

SEQ ID NO: 29954 - DNA, 16 bp, Artificial Sequence
  synthetic [barcode part1]
tcgatcctcacacgac

SEQ ID NO: 29955 - DNA, 16 bp, Artificial Sequence
  synthetic [barcode part1]
tatcggaacaatccgc

SEQ ID NO: 29956 - DNA, 16 bp, Artificial Sequence
  synthetic [barcode part1]
gtggagtacgaacctg

SEQ ID NO: 29957 - DNA, 16 bp, Artificial Sequence
  synthetic [barcode part1]
tggaactgccacaatc

SEQ ID NO: 29958 - DNA, 16 bp, Artificial Sequence
  synthetic [barcode part1]
tgagatcggttgactc

SEQ ID NO: 29959 - DNA, 16 bp, Artificial Sequence
  synthetic [barcode part1]
cgtagtactacggtac

SEQ ID NO: 29960 - DNA, 16 bp, Artificial Sequence
  synthetic [barcode part1]
gagtgactacgaattg

SEQ ID NO: 29961 - DNA, 16 bp, Artificial Sequence
  synthetic [barcode part1]
gcctcgataataccag

SEQ ID NO: 29962 - DNA, 16 bp, Artificial Sequence
  synthetic [barcode part1]
gactgttcagagatag

SEQ ID NO: 29963 - DNA, 16 bp, Artificial Sequence
  synthetic [barcode part1]
caatacgaagacgatc

SEQ ID NO: 29964 - DNA, 16 bp, Artificial Sequence
  synthetic [barcode part1]
gatcgagtcgtgtgag

SEQ ID NO: 29965 - DNA, 16 bp, Artificial Sequence
  synthetic [barcode part1]
aacaggccactgcaag

SEQ ID NO: 29966 - DNA, 16 bp, Artificial Sequence
  synthetic [barcode part1]
aagaccgaatcacgcg

SEQ ID NO: 29967 - DNA, 16 bp, Artificial Sequence
  synthetic [barcode part1]
gcagactccaatacgt

SEQ ID NO: 29968 - DNA, 16 bp, Artificial Sequence
  synthetic [barcode part1]
cggcgtgattgagagt

SEQ ID NO: 29969 - DNA, 16 bp, Artificial Sequence
  synthetic [barcode part1]
ttccagtatatccggt

SEQ ID NO: 29970 - DNA, 16 bp, Artificial Sequence
  synthetic [barcode part1]
cacttccaccggattg

SEQ ID NO: 29971 - DNA, 16 bp, Artificial Sequence
  synthetic [barcode part1]
cgtactagattccttg

SEQ ID NO: 29972 - DNA, 16 bp, Artificial Sequence
  synthetic [barcode part1]
cgttcgcgtagtacct

SEQ ID NO: 29973 - DNA, 16 bp, Artificial Sequence
  synthetic [barcode part1]
gcctactgacactgtc

SEQ ID NO: 29974 - DNA, 16 bp, Artificial Sequence
  synthetic [barcode part1]
agttgcagtaccagtc

SEQ ID NO: 29975 - DNA, 16 bp, Artificial Sequence
  synthetic [barcode part1]
aggtgttccacaagtc

SEQ ID NO: 29976 - DNA, 16 bp, Artificial Sequence
  synthetic [barcode part1]
acactgacctcgtcac

SEQ ID NO: 29977 - DNA, 16 bp, Artificial Sequence
  synthetic [barcode part1]
gcggatatacctactg

SEQ ID NO: 29978 - DNA, 16 bp, Artificial Sequence
  synthetic [barcode part1]
cacgtctactcaacgc

SEQ ID NO: 29979 - DNA, 16 bp, Artificial Sequence
  synthetic [barcode part1]
gagtgccaggtgatac

SEQ ID NO: 29980 - DNA, 16 bp, Artificial Sequence
  synthetic [barcode part1]
ttagtccacgactact

SEQ ID NO: 29981 - DNA, 16 bp, Artificial Sequence
  synthetic [barcode part1]
tattattcgccagtgc

SEQ ID NO: 29982 - DNA, 16 bp, Artificial Sequence
  synthetic [barcode part1]
tacacgtgtacacgtg

SEQ ID NO: 29983 - DNA, 16 bp, Artificial Sequence
  synthetic [barcode part1]
ttcgacacaccaagtg

SEQ ID NO: 29984 - DNA, 16 bp, Artificial Sequence
  synthetic [barcode part1]
cggcaggttataggtg

SEQ ID NO: 29985 - DNA, 16 bp, Artificial Sequence
  synthetic [barcode part1]
gacgtcgactatagtc

SEQ ID NO: 29986 - DNA, 16 bp, Artificial Sequence
  synthetic [barcode part1]
cagttctcgtacgatt

SEQ ID NO: 29987 - DNA, 16 bp, Artificial Sequence
  synthetic [barcode part1]
tcgagacgcaacactt

SEQ ID NO: 29988 - DNA, 16 bp, Artificial Sequence
  synthetic [barcode part1]
gcaatcgcgatacgtt

SEQ ID NO: 29989 - DNA, 16 bp, Artificial Sequence
  synthetic [barcode part1]
gtgaaggccgaattgc

SEQ ID NO: 29990 - DNA, 16 bp, Artificial Sequence
  synthetic [barcode part1]
gtgtactaggtatccg

SEQ ID NO: 29991 - DNA, 16 bp, Artificial Sequence
  synthetic [barcode part1]
aggaacaggacacagt

SEQ ID NO: 29992 - DNA, 16 bp, Artificial Sequence
  synthetic [barcode part1]
tcactcgtactacaac

SEQ ID NO: 29993 - DNA, 16 bp, Artificial Sequence
  synthetic [barcode part1]
accacagataagtggt

SEQ ID NO: 29994 - DNA, 16 bp, Artificial Sequence
  synthetic [barcode part1]
gtgactgtggtacgtt

SEQ ID NO: 29995 - DNA, 16 bp, Artificial Sequence
  synthetic [barcode part1]
ttcttgatacacggtc

SEQ ID NO: 29996 - DNA, 16 bp, Artificial Sequence
  synthetic [barcode part1]
aaccgcaattgcgtgt

SEQ ID NO: 29997 - DNA, 16 bp, Artificial Sequence
  synthetic [barcode part1]
gaggttgtaatctccg

SEQ ID NO: 29998 - DNA, 16 bp, Artificial Sequence
  synthetic [barcode part1]
tcttcggcaatatacc

SEQ ID NO: 29999 - DNA, 16 bp, Artificial Sequence
  synthetic [barcode part1]
cagatacctctatcac

SEQ ID NO: 30000 - DNA, 16 bp, Artificial Sequence
  synthetic [barcode part1]
tagtcgtagattggag

SEQ ID NO: 30001 - DNA, 16 bp, Artificial Sequence
  synthetic [barcode part1]
cagtcgaactgatcgt

SEQ ID NO: 30002 - DNA, 16 bp, Artificial Sequence
  synthetic [barcode part1]
aaggcgttcggtagtg

SEQ ID NO: 30003 - DNA, 16 bp, Artificial Sequence
  synthetic [barcode part1]
gtcaacgtactggtgt

SEQ ID NO: 30004 - DNA, 16 bp, Artificial Sequence
  synthetic [barcode part1]
taccactcgaggaact

SEQ ID NO: 30005 - DNA, 16 bp, Artificial Sequence
  synthetic [barcode part1]
cgttgattcctggtcg

SEQ ID NO: 30006 - DNA, 16 bp, Artificial Sequence
  synthetic [barcode part1]
tgaccttgcacaccgt

SEQ ID NO: 30007 - DNA, 16 bp, Artificial Sequence
  synthetic [barcode part1]
agttctcgtcgtctct

SEQ ID NO: 30008 - DNA, 16 bp, Artificial Sequence
  synthetic [barcode part1]
cacggattcgcaagtt

SEQ ID NO: 30009 - DNA, 16 bp, Artificial Sequence
  synthetic [barcode part1]
cgagatcactgtgact

SEQ ID NO: 30010 - DNA, 16 bp, Artificial Sequence
  synthetic [barcode part1]
caactacctcaacttg

SEQ ID NO: 30011 - DNA, 16 bp, Artificial Sequence
  synthetic [barcode part1]
caggaactatcggacg

SEQ ID NO: 30012 - DNA, 16 bp, Artificial Sequence
  synthetic [barcode part1]
gacttcagtccactcg

SEQ ID NO: 30013 - DNA, 16 bp, Artificial Sequence
  synthetic [barcode part1]
gtgaggagattcaatc

SEQ ID NO: 30014 - DNA, 16 bp, Artificial Sequence
  synthetic [barcode part1]
cggatcaccttgcact

SEQ ID NO: 30015 - DNA, 16 bp, Artificial Sequence
  synthetic [barcode part1]
tggagttgaccaatcc

SEQ ID NO: 30016 - DNA, 16 bp, Artificial Sequence
  synthetic [barcode part1]
tatctgtcgagacttc

SEQ ID NO: 30017 - DNA, 16 bp, Artificial Sequence
  synthetic [barcode part1]
ttctatccaagtaccg

SEQ ID NO: 30018 - DNA, 16 bp, Artificial Sequence
  synthetic [barcode part1]
aggtatcttgtaggcc

SEQ ID NO: 30019 - DNA, 16 bp, Artificial Sequence
  synthetic [barcode part1]
agaaggtggtatacct

SEQ ID NO: 30020 - DNA, 16 bp, Artificial Sequence
  synthetic [barcode part1]
tacggttgatcacacg

SEQ ID NO: 30021 - DNA, 16 bp, Artificial Sequence
  synthetic [barcode part1]
tggtcgaacgtacact

SEQ ID NO: 30022 - DNA, 16 bp, Artificial Sequence
  synthetic [barcode part1]
tcggatatctgttacc

SEQ ID NO: 30023 - DNA, 16 bp, Artificial Sequence
  synthetic [barcode part1]
ttaccgtcagatacct

SEQ ID NO: 30024 - DNA, 16 bp, Artificial Sequence
  synthetic [barcode part1]
tgtactggttgacacg

SEQ ID NO: 30025 - DNA, 16 bp, Artificial Sequence
  synthetic [barcode part1]
gtactcctcaggtcac

SEQ ID NO: 30026 - DNA, 16 bp, Artificial Sequence
  synthetic [barcode part1]
tggtggatccgagtag

SEQ ID NO: 30027 - DNA, 16 bp, Artificial Sequence
  synthetic [barcode part1]
tctctccgacttcagt

SEQ ID NO: 30028 - DNA, 16 bp, Artificial Sequence
  synthetic [barcode part1]
cacgacacagacaggt

SEQ ID NO: 30029 - DNA, 16 bp, Artificial Sequence
  synthetic [barcode part1]
cgccaacctagaagag

SEQ ID NO: 30030 - DNA, 16 bp, Artificial Sequence
  synthetic [barcode part1]
cgtgatacactgcaac

SEQ ID NO: 30031 - DNA, 16 bp, Artificial Sequence
  synthetic [barcode part1]
tgtgacaaggtcttgc

SEQ ID NO: 30032 - DNA, 16 bp, Artificial Sequence
  synthetic [barcode part1]
cctgttaccaggtatt

SEQ ID NO: 30033 - DNA, 16 bp, Artificial Sequence
  synthetic [barcode part1]
tacgtcaacacgtcag

SEQ ID NO: 30034 - DNA, 16 bp, Artificial Sequence
  synthetic [barcode part1]
accacagacagtacct

SEQ ID NO: 30035 - DNA, 16 bp, Artificial Sequence
  synthetic [barcode part1]
ttatagtgaccgaccg

SEQ ID NO: 30036 - DNA, 16 bp, Artificial Sequence
  synthetic [barcode part1]
accgagtcgaatcact

SEQ ID NO: 30037 - DNA, 16 bp, Artificial Sequence
  synthetic [barcode part1]
gcagacagagtctcag

SEQ ID NO: 30038 - DNA, 16 bp, Artificial Sequence
  synthetic [barcode part1]
tagattgcgacggtct

SEQ ID NO: 30039 - DNA, 16 bp, Artificial Sequence
  synthetic [barcode part1]
tgatcctgcaccgact

SEQ ID NO: 30040 - DNA, 16 bp, Artificial Sequence
  synthetic [barcode part1]
tgacgacctctatact

SEQ ID NO: 30041 - DNA, 16 bp, Artificial Sequence
  synthetic [barcode part1]
cctcggttagtagagt

SEQ ID NO: 30042 - DNA, 16 bp, Artificial Sequence
  synthetic [barcode part1]
tcagtcacacagtgtg

SEQ ID NO: 30043 - DNA, 16 bp, Artificial Sequence
  synthetic [barcode part1]
gtggtgttgaccagtt

SEQ ID NO: 30044 - DNA, 16 bp, Artificial Sequence
  synthetic [barcode part1]
cagtatcttgttcacg

SEQ ID NO: 30045 - DNA, 16 bp, Artificial Sequence
  synthetic [barcode part1]
tgcaacactgtctatc

SEQ ID NO: 30046 - DNA, 16 bp, Artificial Sequence
  synthetic [barcode part1]
cgccacaattagtcag

SEQ ID NO: 30047 - DNA, 16 bp, Artificial Sequence
  synthetic [barcode part1]
atcacaccgtagactg

SEQ ID NO: 30048 - DNA, 16 bp, Artificial Sequence
  synthetic [barcode part1]
tgttgttcgtctcacc

SEQ ID NO: 30049 - DNA, 16 bp, Artificial Sequence
  synthetic [barcode part1]
ccttaacgtgcaactt

SEQ ID NO: 30050 - DNA, 16 bp, Artificial Sequence
  synthetic [barcode part1]
aagtctgttcgtggac

SEQ ID NO: 30051 - DNA, 16 bp, Artificial Sequence
  synthetic [barcode part1]
agttaccggactatcg

SEQ ID NO: 30052 - DNA, 16 bp, Artificial Sequence
  synthetic [barcode part1]
accgttaaggacgcag

SEQ ID NO: 30053 - DNA, 16 bp, Artificial Sequence
  synthetic [barcode part1]
aagtgtcaagtgacac

SEQ ID NO: 30054 - DNA, 16 bp, Artificial Sequence
  synthetic [barcode part1]
agaacggtcacagacc

SEQ ID NO: 30055 - DNA, 16 bp, Artificial Sequence
  synthetic [barcode part1]
gattaatatcggccgc

SEQ ID NO: 30056 - DNA, 16 bp, Artificial Sequence
  synthetic [barcode part1]
tgtgtccgtagagatc

SEQ ID NO: 30057 - DNA, 16 bp, Artificial Sequence
  synthetic [barcode part1]
atacttctcggtaacc

SEQ ID NO: 30058 - DNA, 16 bp, Artificial Sequence
  synthetic [barcode part1]
ttgaagatataggccg

SEQ ID NO: 30059 - DNA, 16 bp, Artificial Sequence
  synthetic [barcode part1]
tcctcacaacacgaag

SEQ ID NO: 30060 - DNA, 16 bp, Artificial Sequence
  synthetic [barcode part1]
taagtaggtccgttcg

SEQ ID NO: 30061 - DNA, 16 bp, Artificial Sequence
  synthetic [barcode part1]
accgagtacagagatt

SEQ ID NO: 30062 - DNA, 16 bp, Artificial Sequence
  synthetic [barcode part1]
gcgaagtaagttcgcg

SEQ ID NO: 30063 - DNA, 16 bp, Artificial Sequence
  synthetic [barcode part1]
ccggttctagactcgt

SEQ ID NO: 30064 - DNA, 16 bp, Artificial Sequence
  synthetic [barcode part1]
agtggtgcggaataag

SEQ ID NO: 30065 - DNA, 16 bp, Artificial Sequence
  synthetic [barcode part1]
cctaacctgacgtacc

SEQ ID NO: 30066 - DNA, 16 bp, Artificial Sequence
  synthetic [barcode part1]
ttccagacagaacctg

SEQ ID NO: 30067 - DNA, 16 bp, Artificial Sequence
  synthetic [barcode part1]
tgacgtgtagtctctt

SEQ ID NO: 30068 - DNA, 16 bp, Artificial Sequence
  synthetic [barcode part1]
tgttaccgtctagact

SEQ ID NO: 30069 - DNA, 16 bp, Artificial Sequence
  synthetic [barcode part1]
cctactgaacctgtgc

SEQ ID NO: 30070 - DNA, 16 bp, Artificial Sequence
  synthetic [barcode part1]
agactgtgcgatctac

SEQ ID NO: 30071 - DNA, 16 bp, Artificial Sequence
  synthetic [barcode part1]
gactgtattccttgac

SEQ ID NO: 30072 - DNA, 16 bp, Artificial Sequence
  synthetic [barcode part1]
cgaacgatactgtaag

SEQ ID NO: 30073 - DNA, 16 bp, Artificial Sequence
  synthetic [barcode part1]
agactggtgtaactag

SEQ ID NO: 30074 - DNA, 16 bp, Artificial Sequence
  synthetic [barcode part1]
ccgacacttggagaag

SEQ ID NO: 30075 - DNA, 16 bp, Artificial Sequence
  synthetic [barcode part1]
tgtgtgtaaccagtcg

SEQ ID NO: 30076 - DNA, 16 bp, Artificial Sequence
  synthetic [barcode part1]
gcgccttgtataaggt

SEQ ID NO: 30077 - DNA, 16 bp, Artificial Sequence
  synthetic [barcode part1]
tctgtccgagtaagtg

SEQ ID NO: 30078 - DNA, 16 bp, Artificial Sequence
  synthetic [barcode part1]
actcgagaacaaggtt

SEQ ID NO: 30079 - DNA, 16 bp, Artificial Sequence
  synthetic [barcode part1]
cgagtatctcttggcc

SEQ ID NO: 30080 - DNA, 16 bp, Artificial Sequence
  synthetic [barcode part1]
gtacgtaactgcaacc

SEQ ID NO: 30081 - DNA, 16 bp, Artificial Sequence
  synthetic [barcode part1]
tcctcagtcgatcttc

SEQ ID NO: 30082 - DNA, 16 bp, Artificial Sequence
  synthetic [barcode part1]
ccgcagatatcttgcc

SEQ ID NO: 30083 - DNA, 16 bp, Artificial Sequence
  synthetic [barcode part1]
cacagatctgtcttac

SEQ ID NO: 30084 - DNA, 16 bp, Artificial Sequence
  synthetic [barcode part1]
attatctcgtccgagt

SEQ ID NO: 30085 - DNA, 16 bp, Artificial Sequence
  synthetic [barcode part1]
ccgaagagtacaaccg

SEQ ID NO: 30086 - DNA, 16 bp, Artificial Sequence
  synthetic [barcode part1]
aactacgaagatcgac

SEQ ID NO: 30087 - DNA, 16 bp, Artificial Sequence
  synthetic [barcode part1]
caactcactcaacgag

SEQ ID NO: 30088 - DNA, 16 bp, Artificial Sequence
  synthetic [barcode part1]
tctaacgtaggtcacg

SEQ ID NO: 30089 - DNA, 16 bp, Artificial Sequence
  synthetic [barcode part1]
gatccgatcggcaatt

SEQ ID NO: 30090 - DNA, 16 bp, Artificial Sequence
  synthetic [barcode part1]
atccgagtctgttact

SEQ ID NO: 30091 - DNA, 16 bp, Artificial Sequence
  synthetic [barcode part1]
attaccttccaccgtc

SEQ ID NO: 30092 - DNA, 16 bp, Artificial Sequence
  synthetic [barcode part1]
gtcgaaccttagtggt

SEQ ID NO: 30093 - DNA, 16 bp, Artificial Sequence
  synthetic [barcode part1]
tctcagataggtagag

SEQ ID NO: 30094 - DNA, 16 bp, Artificial Sequence
  synthetic [barcode part1]
gcactccggcctaatt

SEQ ID NO: 30095 - DNA, 16 bp, Artificial Sequence
  synthetic [barcode part1]
agtctgattcttgtgc

SEQ ID NO: 30096 - DNA, 16 bp, Artificial Sequence
  synthetic [barcode part1]
tgtagtgttgttcgtc

SEQ ID NO: 30097 - DNA, 16 bp, Artificial Sequence
  synthetic [barcode part1]
gagtcacacggagact

SEQ ID NO: 30098 - DNA, 16 bp, Artificial Sequence
  synthetic [barcode part1]
agagtggtaagtatcc

SEQ ID NO: 30099 - DNA, 16 bp, Artificial Sequence
  synthetic [barcode part1]
ttgacgtgtcagtacg

SEQ ID NO: 30100 - DNA, 16 bp, Artificial Sequence
  synthetic [barcode part1]
ccgcgttgacgatctt

SEQ ID NO: 30101 - DNA, 16 bp, Artificial Sequence
  synthetic [barcode part1]
gaggatcctagttctg

SEQ ID NO: 30102 - DNA, 16 bp, Artificial Sequence
  synthetic [barcode part1]
tctcgtgtgattcaac

SEQ ID NO: 30103 - DNA, 16 bp, Artificial Sequence
  synthetic [barcode part1]
accgattccttccttg

SEQ ID NO: 30104 - DNA, 16 bp, Artificial Sequence
  synthetic [barcode part1]
agaagacaacggcagt

SEQ ID NO: 30105 - DNA, 16 bp, Artificial Sequence
  synthetic [barcode part1]
ttaggtgtgaacgtcc

SEQ ID NO: 30106 - DNA, 16 bp, Artificial Sequence
  synthetic [barcode part1]
atcctacactcggatt

SEQ ID NO: 30107 - DNA, 16 bp, Artificial Sequence
  synthetic [barcode part1]
cgcacttaggtcgttc

SEQ ID NO: 30108 - DNA, 16 bp, Artificial Sequence
  synthetic [barcode part1]
actatccgcgaattct

SEQ ID NO: 30109 - DNA, 16 bp, Artificial Sequence
  synthetic [barcode part1]
gcgttgatacagacct

SEQ ID NO: 30110 - DNA, 16 bp, Artificial Sequence
  synthetic [barcode part1]
aatactggcgcgtact

SEQ ID NO: 30111 - DNA, 16 bp, Artificial Sequence
  synthetic [barcode part1]
aggttcttacgacacg

SEQ ID NO: 30112 - DNA, 16 bp, Artificial Sequence
  synthetic [barcode part1]
tatctgtcactgcaac

SEQ ID NO: 30113 - DNA, 16 bp, Artificial Sequence
  synthetic [barcode part1]
tctatacgaaggcgtc

SEQ ID NO: 30114 - DNA, 16 bp, Artificial Sequence
  synthetic [barcode part1]
cctacgtattattggc

SEQ ID NO: 30115 - DNA, 16 bp, Artificial Sequence
  synthetic [barcode part1]
cgtcgacttccaatcg

SEQ ID NO: 30116 - DNA, 16 bp, Artificial Sequence
  synthetic [barcode part1]
tgttgagtactctcac

SEQ ID NO: 30117 - DNA, 16 bp, Artificial Sequence
  synthetic [barcode part1]
tccagttgccagtatt

SEQ ID NO: 30118 - DNA, 16 bp, Artificial Sequence
  synthetic [barcode part1]
aacacgtgactaagac

SEQ ID NO: 30119 - DNA, 16 bp, Artificial Sequence
  synthetic [barcode part1]
ttaaccgtagtcgacg

SEQ ID NO: 30120 - DNA, 16 bp, Artificial Sequence
  synthetic [barcode part1]
cgagactgactaacct

SEQ ID NO: 30121 - DNA, 16 bp, Artificial Sequence
  synthetic [barcode part1]
taagaaggtgccaatc

SEQ ID NO: 30122 - DNA, 16 bp, Artificial Sequence
  synthetic [barcode part1]
acgaactcacgagttc

SEQ ID NO: 30123 - DNA, 16 bp, Artificial Sequence
  synthetic [barcode part1]
acaagttgtcggaagt

SEQ ID NO: 30124 - DNA, 16 bp, Artificial Sequence
  synthetic [barcode part1]
attaacagtctcctgc

SEQ ID NO: 30125 - DNA, 16 bp, Artificial Sequence
  synthetic [barcode part1]
cctaagttgtctcgcg

SEQ ID NO: 30126 - DNA, 16 bp, Artificial Sequence
  synthetic [barcode part1]
tctacgacaccacctg

SEQ ID NO: 30127 - DNA, 16 bp, Artificial Sequence
  synthetic [barcode part1]
tggaggtattcagtag

SEQ ID NO: 30128 - DNA, 16 bp, Artificial Sequence
  synthetic [barcode part1]
tgttagaggaccgtct

SEQ ID NO: 30129 - DNA, 16 bp, Artificial Sequence
  synthetic [barcode part1]
ttcagttgcaccggtc

SEQ ID NO: 30130 - DNA, 16 bp, Artificial Sequence
  synthetic [barcode part1]
gtgtaataccacgcgt

SEQ ID NO: 30131 - DNA, 16 bp, Artificial Sequence
  synthetic [barcode part1]
cacgttcgtctaatac

SEQ ID NO: 30132 - DNA, 16 bp, Artificial Sequence
  synthetic [barcode part1]
tgtcacctgccagtac

SEQ ID NO: 30133 - DNA, 16 bp, Artificial Sequence
  synthetic [barcode part1]
tccggagtataacgtc

SEQ ID NO: 30134 - DNA, 16 bp, Artificial Sequence
  synthetic [barcode part1]
tcgaagtggcaggtac

SEQ ID NO: 30135 - DNA, 16 bp, Artificial Sequence
  synthetic [barcode part1]
aagtctggttcgagtc

SEQ ID NO: 30136 - DNA, 16 bp, Artificial Sequence
  synthetic [barcode part1]
aacctcttacagacct

SEQ ID NO: 30137 - DNA, 16 bp, Artificial Sequence
  synthetic [barcode part1]
gcggagacaataatct

SEQ ID NO: 30138 - DNA, 16 bp, Artificial Sequence
  synthetic [barcode part1]
gtgaggtcagacactg

SEQ ID NO: 30139 - DNA, 16 bp, Artificial Sequence
  synthetic [barcode part1]
tatagaggtgcggaag

SEQ ID NO: 30140 - DNA, 16 bp, Artificial Sequence
  synthetic [barcode part1]
tctaggactctaggac

SEQ ID NO: 30141 - DNA, 16 bp, Artificial Sequence
  synthetic [barcode part1]
gtggtatagttccgac

SEQ ID NO: 30142 - DNA, 16 bp, Artificial Sequence
  synthetic [barcode part1]
caacgtaactgagaac

SEQ ID NO: 30143 - DNA, 16 bp, Artificial Sequence
  synthetic [barcode part1]
tccgattcttcctggt

SEQ ID NO: 30144 - DNA, 16 bp, Artificial Sequence
  synthetic [barcode part1]
cgccggacctatactt

SEQ ID NO: 30145 - DNA, 16 bp, Artificial Sequence
  synthetic [barcode part1]
cgaccacttacacaag

SEQ ID NO: 30146 - DNA, 16 bp, Artificial Sequence
  synthetic [barcode part1]
aggaagtatccagact

SEQ ID NO: 30147 - DNA, 16 bp, Artificial Sequence
  synthetic [barcode part1]
gaaggtcaatctctcg

SEQ ID NO: 30148 - DNA, 16 bp, Artificial Sequence
  synthetic [barcode part1]
ttctggttacggatct

SEQ ID NO: 30149 - DNA, 16 bp, Artificial Sequence
  synthetic [barcode part1]
ttcggaaggaatcctc

SEQ ID NO: 30150 - DNA, 16 bp, Artificial Sequence
  synthetic [barcode part1]
gatcgaggttccttag

SEQ ID NO: 30151 - DNA, 16 bp, Artificial Sequence
  synthetic [barcode part1]
acactaggttgttctc

SEQ ID NO: 30152 - DNA, 16 bp, Artificial Sequence
  synthetic [barcode part1]
gtctgaacactgcctc

SEQ ID NO: 30153 - DNA, 16 bp, Artificial Sequence
  synthetic [barcode part1]
actatcttggacgttc

SEQ ID NO: 30154 - DNA, 16 bp, Artificial Sequence
  synthetic [barcode part1]
gttagatcggaagtgt

SEQ ID NO: 30155 - DNA, 16 bp, Artificial Sequence
  synthetic [barcode part1]
gcgtctgcgttacttg

SEQ ID NO: 30156 - DNA, 16 bp, Artificial Sequence
  synthetic [barcode part1]
acggaagatacgagac

SEQ ID NO: 30157 - DNA, 16 bp, Artificial Sequence
  synthetic [barcode part1]
cgagatcttaaggcct

SEQ ID NO: 30158 - DNA, 16 bp, Artificial Sequence
  synthetic [barcode part1]
taactccaccaacgtt

SEQ ID NO: 30159 - DNA, 16 bp, Artificial Sequence
  synthetic [barcode part1]
gtgtatctgttctgtg

SEQ ID NO: 30160 - DNA, 16 bp, Artificial Sequence
  synthetic [barcode part1]
acaggttcgtaggttc

SEQ ID NO: 30161 - DNA, 16 bp, Artificial Sequence
  synthetic [barcode part1]
cagtctataggagtag

SEQ ID NO: 30162 - DNA, 16 bp, Artificial Sequence
  synthetic [barcode part1]
ttagatacgaggcaac

SEQ ID NO: 30163 - DNA, 16 bp, Artificial Sequence
  synthetic [barcode part1]
agattgtgacacaggt

SEQ ID NO: 30164 - DNA, 16 bp, Artificial Sequence
  synthetic [barcode part1]
cagagacagaccactg

SEQ ID NO: 30165 - DNA, 16 bp, Artificial Sequence
  synthetic [barcode part1]
tgaacaacactcaccg

SEQ ID NO: 30166 - DNA, 16 bp, Artificial Sequence
  synthetic [barcode part1]
gaatcgtaccttcgcc

SEQ ID NO: 30167 - DNA, 16 bp, Artificial Sequence
  synthetic [barcode part1]
cgtcctgagacctgtt

SEQ ID NO: 30168 - DNA, 16 bp, Artificial Sequence
  synthetic [barcode part1]
agtctagtggtagtcc

SEQ ID NO: 30169 - DNA, 16 bp, Artificial Sequence
  synthetic [barcode part1]
tccaccggtattcggt

SEQ ID NO: 30170 - DNA, 16 bp, Artificial Sequence
  synthetic [barcode part1]
aagtccggagtatcct

SEQ ID NO: 30171 - DNA, 16 bp, Artificial Sequence
  synthetic [barcode part1]
tgcaggtctgcaagtt

SEQ ID NO: 30172 - DNA, 16 bp, Artificial Sequence
  synthetic [barcode part1]
gtacgattggtacgtc

SEQ ID NO: 30173 - DNA, 16 bp, Artificial Sequence
  synthetic [barcode part1]
taggcgtcggtaaggt

SEQ ID NO: 30174 - DNA, 16 bp, Artificial Sequence
  synthetic [barcode part1]
aaccacaaccagtgtc

SEQ ID NO: 30175 - DNA, 16 bp, Artificial Sequence
  synthetic [barcode part1]
atatactcgtcggcag

SEQ ID NO: 30176 - DNA, 16 bp, Artificial Sequence
  synthetic [barcode part1]
cacgcgatattggtac

SEQ ID NO: 30177 - DNA, 16 bp, Artificial Sequence
  synthetic [barcode part1]
ccttgtatcggtagtt

SEQ ID NO: 30178 - DNA, 16 bp, Artificial Sequence
  synthetic [barcode part1]
tcagatcgaggcgtag

SEQ ID NO: 30179 - DNA, 16 bp, Artificial Sequence
  synthetic [barcode part1]
gtgttgacgtgtcaac

SEQ ID NO: 30180 - DNA, 16 bp, Artificial Sequence
  synthetic [barcode part1]
tctcgtgtcctgtatc

SEQ ID NO: 30181 - DNA, 16 bp, Artificial Sequence
  synthetic [barcode part1]
tactgtcaacacacct

SEQ ID NO: 30182 - DNA, 16 bp, Artificial Sequence
  synthetic [barcode part1]
gcaatctgtagaagtg

SEQ ID NO: 30183 - DNA, 16 bp, Artificial Sequence
  synthetic [barcode part1]
gtatcagtcagacgtc

SEQ ID NO: 30184 - DNA, 16 bp, Artificial Sequence
  synthetic [barcode part1]
tagacgtgttggaggc

SEQ ID NO: 30185 - DNA, 16 bp, Artificial Sequence
  synthetic [barcode part1]
atctaggcgtcgtctc

SEQ ID NO: 30186 - DNA, 16 bp, Artificial Sequence
  synthetic [barcode part1]
cctataggtaagtccg

SEQ ID NO: 30187 - DNA, 16 bp, Artificial Sequence
  synthetic [barcode part1]
gtgatctgtgaggacg

SEQ ID NO: 30188 - DNA, 16 bp, Artificial Sequence
  synthetic [barcode part1]
ttcgtgcactattgac

SEQ ID NO: 30189 - DNA, 16 bp, Artificial Sequence
  synthetic [barcode part1]
ttcgactcagttacgt

SEQ ID NO: 30190 - DNA, 16 bp, Artificial Sequence
  synthetic [barcode part1]
cgtacgacgtcctact

SEQ ID NO: 30191 - DNA, 16 bp, Artificial Sequence
  synthetic [barcode part1]
gatacgtcgtagttgc

SEQ ID NO: 30192 - DNA, 16 bp, Artificial Sequence
  synthetic [barcode part1]
tgtgtagacgattgcc

SEQ ID NO: 30193 - DNA, 16 bp, Artificial Sequence
  synthetic [barcode part1]
ttcgaggtcgactagt

SEQ ID NO: 30194 - DNA, 16 bp, Artificial Sequence
  synthetic [barcode part1]
gagtgttcctgttgcc

SEQ ID NO: 30195 - DNA, 16 bp, Artificial Sequence
  synthetic [barcode part1]
tctagagttgaggtcc

SEQ ID NO: 30196 - DNA, 16 bp, Artificial Sequence
  synthetic [barcode part1]
tcgatcaggaatctcg

SEQ ID NO: 30197 - DNA, 16 bp, Artificial Sequence
  synthetic [barcode part1]
ccgtacttacttctgc

SEQ ID NO: 30198 - DNA, 16 bp, Artificial Sequence
  synthetic [barcode part1]
taaggaagtcgcgcac

SEQ ID NO: 30199 - DNA, 16 bp, Artificial Sequence
  synthetic [barcode part1]
ttgtgcctatctctgc

SEQ ID NO: 30200 - DNA, 16 bp, Artificial Sequence
  synthetic [barcode part1]
gtccaccagtgtcgtt

SEQ ID NO: 30201 - DNA, 16 bp, Artificial Sequence
  synthetic [barcode part1]
tctctctgcactgtac

SEQ ID NO: 30202 - DNA, 16 bp, Artificial Sequence
  synthetic [barcode part1]
aaccttgcgttgcaag

SEQ ID NO: 30203 - DNA, 16 bp, Artificial Sequence
  synthetic [barcode part1]
gttcgaattgtggacc

SEQ ID NO: 30204 - DNA, 16 bp, Artificial Sequence
  synthetic [barcode part1]
tcgacctgtctgaacc

SEQ ID NO: 30205 - DNA, 16 bp, Artificial Sequence
  synthetic [barcode part1]
cgcctccagaatatag

SEQ ID NO: 30206 - DNA, 16 bp, Artificial Sequence
  synthetic [barcode part1]
gtgacgtctgagatct

SEQ ID NO: 30207 - DNA, 16 bp, Artificial Sequence
  synthetic [barcode part1]
aacgttgtgcacacac

SEQ ID NO: 30208 - DNA, 16 bp, Artificial Sequence
  synthetic [barcode part1]
ccacaggagatattcc

SEQ ID NO: 30209 - DNA, 16 bp, Artificial Sequence
  synthetic [barcode part1]
cacctacgttctggac

SEQ ID NO: 30210 - DNA, 16 bp, Artificial Sequence
  synthetic [barcode part1]
cgcacactatagtacg

SEQ ID NO: 30211 - DNA, 16 bp, Artificial Sequence
  synthetic [barcode part1]
aggcgatagtcacacg

SEQ ID NO: 30212 - DNA, 16 bp, Artificial Sequence
  synthetic [barcode part1]
atccaactcttgtgtg

SEQ ID NO: 30213 - DNA, 16 bp, Artificial Sequence
  synthetic [barcode part1]
ccgcagtacactatag

SEQ ID NO: 30214 - DNA, 16 bp, Artificial Sequence
  synthetic [barcode part1]
agaaggttccgatcct

SEQ ID NO: 30215 - DNA, 16 bp, Artificial Sequence
  synthetic [barcode part1]
ttcaagacggccgatt

SEQ ID NO: 30216 - DNA, 16 bp, Artificial Sequence
  synthetic [barcode part1]
gcggtaatctgatctg

SEQ ID NO: 30217 - DNA, 16 bp, Artificial Sequence
  synthetic [barcode part1]
atctgttgcaacgttc

SEQ ID NO: 30218 - DNA, 16 bp, Artificial Sequence
  synthetic [barcode part1]
atataaccacgcggtc

SEQ ID NO: 30219 - DNA, 16 bp, Artificial Sequence
  synthetic [barcode part1]
tccgcacgtatagagt

SEQ ID NO: 30220 - DNA, 16 bp, Artificial Sequence
  synthetic [barcode part1]
aattgaggcctcctag

SEQ ID NO: 30221 - DNA, 16 bp, Artificial Sequence
  synthetic [barcode part1]
attaggtctgccgagt

SEQ ID NO: 30222 - DNA, 16 bp, Artificial Sequence
  synthetic [barcode part1]
actaacgatcttccac

SEQ ID NO: 30223 - DNA, 16 bp, Artificial Sequence
  synthetic [barcode part1]
cacgacctctctagtg

SEQ ID NO: 30224 - DNA, 16 bp, Artificial Sequence
  synthetic [barcode part1]
tcgagtaatcctatcc

SEQ ID NO: 30225 - DNA, 16 bp, Artificial Sequence
  synthetic [barcode part1]
gacggtctcctgtatc

SEQ ID NO: 30226 - DNA, 16 bp, Artificial Sequence
  synthetic [barcode part1]
aacctgttccagacag

SEQ ID NO: 30227 - DNA, 16 bp, Artificial Sequence
  synthetic [barcode part1]
tactactctcgacctc

SEQ ID NO: 30228 - DNA, 16 bp, Artificial Sequence
  synthetic [barcode part1]
acttggtaagagtacg

SEQ ID NO: 30229 - DNA, 16 bp, Artificial Sequence
  synthetic [barcode part1]
tgcaggccggaataac

SEQ ID NO: 30230 - DNA, 16 bp, Artificial Sequence
  synthetic [barcode part1]
aggtcagttaactccg

SEQ ID NO: 30231 - DNA, 16 bp, Artificial Sequence
  synthetic [barcode part1]
tcacgcgtgcaattag

SEQ ID NO: 30232 - DNA, 16 bp, Artificial Sequence
  synthetic [barcode part1]
agttctcaggacggtt

SEQ ID NO: 30233 - DNA, 16 bp, Artificial Sequence
  synthetic [barcode part1]
gtctggaatcttacct

SEQ ID NO: 30234 - DNA, 16 bp, Artificial Sequence
  synthetic [barcode part1]
cagagagttaggagac

SEQ ID NO: 30235 - DNA, 16 bp, Artificial Sequence
  synthetic [barcode part1]
tcgtacaggtctcctg

SEQ ID NO: 30236 - DNA, 16 bp, Artificial Sequence
  synthetic [barcode part1]
caggtgtgatcacact

SEQ ID NO: 30237 - DNA, 16 bp, Artificial Sequence
  synthetic [barcode part1]
ccttagtcgacgaagt

SEQ ID NO: 30238 - DNA, 16 bp, Artificial Sequence
  synthetic [barcode part1]
tatcggatccagtgac

SEQ ID NO: 30239 - DNA, 16 bp, Artificial Sequence
  synthetic [barcode part1]
tatcgcacaatcggtg

SEQ ID NO: 30240 - DNA, 16 bp, Artificial Sequence
  synthetic [barcode part1]
atcactcactcgcggt

SEQ ID NO: 30241 - DNA, 16 bp, Artificial Sequence
  synthetic [barcode part1]
ttggtctggcaacagt

SEQ ID NO: 30242 - DNA, 16 bp, Artificial Sequence
  synthetic [barcode part1]
aggagtagaatcacct

SEQ ID NO: 30243 - DNA, 16 bp, Artificial Sequence
  synthetic [barcode part1]
atagagtggattcgtg

SEQ ID NO: 30244 - DNA, 16 bp, Artificial Sequence
  synthetic [barcode part1]
gaccttaatctgttcg

SEQ ID NO: 30245 - DNA, 16 bp, Artificial Sequence
  synthetic [barcode part1]
tcttagtctggcacgc

SEQ ID NO: 30246 - DNA, 16 bp, Artificial Sequence
  synthetic [barcode part1]
agaataaccacggact

SEQ ID NO: 30247 - DNA, 16 bp, Artificial Sequence
  synthetic [barcode part1]
aattagtgcgtcacgc

SEQ ID NO: 30248 - DNA, 16 bp, Artificial Sequence
  synthetic [barcode part1]
gactaacacgcgtatc

SEQ ID NO: 30249 - DNA, 16 bp, Artificial Sequence
  synthetic [barcode part1]
ttatacagagagaccg

SEQ ID NO: 30250 - DNA, 16 bp, Artificial Sequence
  synthetic [barcode part1]
actcgtctctacttgc

SEQ ID NO: 30251 - DNA, 16 bp, Artificial Sequence
  synthetic [barcode part1]
accaggtggtacgagt

SEQ ID NO: 30252 - DNA, 16 bp, Artificial Sequence
  synthetic [barcode part1]
tggccttccttaactc

SEQ ID NO: 30253 - DNA, 16 bp, Artificial Sequence
  synthetic [barcode part1]
tgttgtgactgcagtg

SEQ ID NO: 30254 - DNA, 16 bp, Artificial Sequence
  synthetic [barcode part1]
tagtacgaagacaacc

SEQ ID NO: 30255 - DNA, 16 bp, Artificial Sequence
  synthetic [barcode part1]
atactctgaaggtgcc

SEQ ID NO: 30256 - DNA, 16 bp, Artificial Sequence
  synthetic [barcode part1]
atcactcgtctgcggt

SEQ ID NO: 30257 - DNA, 16 bp, Artificial Sequence
  synthetic [barcode part1]
gtggaggattaagtct

SEQ ID NO: 30258 - DNA, 16 bp, Artificial Sequence
  synthetic [barcode part1]
ccggagtatctacctc

SEQ ID NO: 30259 - DNA, 16 bp, Artificial Sequence
  synthetic [barcode part1]
tattagtaggaccgag

SEQ ID NO: 30260 - DNA, 16 bp, Artificial Sequence
  synthetic [barcode part1]
cagtcggtaactaacc

SEQ ID NO: 30261 - DNA, 16 bp, Artificial Sequence
  synthetic [barcode part1]
ttggtgtctccgatcg

SEQ ID NO: 30262 - DNA, 16 bp, Artificial Sequence
  synthetic [barcode part1]
cgcaggcaacaagact

SEQ ID NO: 30263 - DNA, 16 bp, Artificial Sequence
  synthetic [barcode part1]
agttctgaagtagacg

SEQ ID NO: 30264 - DNA, 16 bp, Artificial Sequence
  synthetic [barcode part1]
tgatacgttggcgtac

SEQ ID NO: 30265 - DNA, 16 bp, Artificial Sequence
  synthetic [barcode part1]
tgatagtcgactcggt

SEQ ID NO: 30266 - DNA, 16 bp, Artificial Sequence
  synthetic [barcode part1]
tctcgactagtccttc

SEQ ID NO: 30267 - DNA, 16 bp, Artificial Sequence
  synthetic [barcode part1]
tcggcaacgaaggtgt

SEQ ID NO: 30268 - DNA, 16 bp, Artificial Sequence
  synthetic [barcode part1]
cggtaacgtcgaactt

SEQ ID NO: 30269 - DNA, 16 bp, Artificial Sequence
  synthetic [barcode part1]
gatctagaacctggtc

SEQ ID NO: 30270 - DNA, 16 bp, Artificial Sequence
  synthetic [barcode part1]
tccaggcgaatcgaag

SEQ ID NO: 30271 - DNA, 16 bp, Artificial Sequence
  synthetic [barcode part1]
caatcgttcacacgag

SEQ ID NO: 30272 - DNA, 16 bp, Artificial Sequence
  synthetic [barcode part1]
aggccggatattggtg

SEQ ID NO: 30273 - DNA, 16 bp, Artificial Sequence
  synthetic [barcode part1]
tcaatccgtaaccact

SEQ ID NO: 30274 - DNA, 16 bp, Artificial Sequence
  synthetic [barcode part1]
agattccgcactgtag

SEQ ID NO: 30275 - DNA, 16 bp, Artificial Sequence
  synthetic [barcode part1]
gatcgattcttcctcc

SEQ ID NO: 30276 - DNA, 16 bp, Artificial Sequence
  synthetic [barcode part1]
cctaacacgttagacg

SEQ ID NO: 30277 - DNA, 16 bp, Artificial Sequence
  synthetic [barcode part1]
tcgtcctgttaccttg

SEQ ID NO: 30278 - DNA, 16 bp, Artificial Sequence
  synthetic [barcode part1]
agtggagtgtgttggc

SEQ ID NO: 30279 - DNA, 16 bp, Artificial Sequence
  synthetic [barcode part1]
tggactattgaaccgc

SEQ ID NO: 30280 - DNA, 16 bp, Artificial Sequence
  synthetic [barcode part1]
gacctgaggttcgatt

SEQ ID NO: 30281 - DNA, 16 bp, Artificial Sequence
  synthetic [barcode part1]
tgtcgtagaggttctg

SEQ ID NO: 30282 - DNA, 16 bp, Artificial Sequence
  synthetic [barcode part1]
cctctgagtacaccac

SEQ ID NO: 30283 - DNA, 16 bp, Artificial Sequence
  synthetic [barcode part1]
gccacaatacctactt

SEQ ID NO: 30284 - DNA, 16 bp, Artificial Sequence
  synthetic [barcode part1]
cggatacaaggaccgt

SEQ ID NO: 30285 - DNA, 16 bp, Artificial Sequence
  synthetic [barcode part1]
tcgcggtgttaatcag

SEQ ID NO: 30286 - DNA, 16 bp, Artificial Sequence
  synthetic [barcode part1]
tgcctacttgcagtgc

SEQ ID NO: 30287 - DNA, 16 bp, Artificial Sequence
  synthetic [barcode part1]
taaccgtctatcactg

SEQ ID NO: 30288 - DNA, 16 bp, Artificial Sequence
  synthetic [barcode part1]
ccaccttgcactcaag

SEQ ID NO: 30289 - DNA, 16 bp, Artificial Sequence
  synthetic [barcode part1]
cgataggtggacactg

SEQ ID NO: 30290 - DNA, 16 bp, Artificial Sequence
  synthetic [barcode part1]
ttgattatcgaggccg

SEQ ID NO: 30291 - DNA, 16 bp, Artificial Sequence
  synthetic [barcode part1]
gactgtgttctggcct

SEQ ID NO: 30292 - DNA, 16 bp, Artificial Sequence
  synthetic [barcode part1]
ttggaggaaccgtacg

SEQ ID NO: 30293 - DNA, 16 bp, Artificial Sequence
  synthetic [barcode part1]
tcgagttgtgcggaag

SEQ ID NO: 30294 - DNA, 16 bp, Artificial Sequence
  synthetic [barcode part1]
tcagtagtatcctcac

SEQ ID NO: 30295 - DNA, 16 bp, Artificial Sequence
  synthetic [barcode part1]
gaatccgttacacggt

SEQ ID NO: 30296 - DNA, 16 bp, Artificial Sequence
  synthetic [barcode part1]
tagatacggaacggtt

SEQ ID NO: 30297 - DNA, 16 bp, Artificial Sequence
  synthetic [barcode part1]
tcagtaggagtgtggc

SEQ ID NO: 30298 - DNA, 16 bp, Artificial Sequence
  synthetic [barcode part1]
tcagttctcgtgtagt

SEQ ID NO: 30299 - DNA, 16 bp, Artificial Sequence
  synthetic [barcode part1]
tggattgtgatctggc

SEQ ID NO: 30300 - DNA, 16 bp, Artificial Sequence
  synthetic [barcode part1]
tatcctggccttgtct

SEQ ID NO: 30301 - DNA, 16 bp, Artificial Sequence
  synthetic [barcode part1]
agtacaccgtaatcgc

SEQ ID NO: 30302 - DNA, 16 bp, Artificial Sequence
  synthetic [barcode part1]
tatcgtgactacggtg

SEQ ID NO: 30303 - DNA, 16 bp, Artificial Sequence
  synthetic [barcode part1]
cacgtgacttacgagt

SEQ ID NO: 30304 - DNA, 16 bp, Artificial Sequence
  synthetic [barcode part1]
tgaaggaatacaccgt

SEQ ID NO: 30305 - DNA, 16 bp, Artificial Sequence
  synthetic [barcode part1]
cgataacgagaacgcc

SEQ ID NO: 30306 - DNA, 16 bp, Artificial Sequence
  synthetic [barcode part1]
gtgttagagagtggcc

SEQ ID NO: 30307 - DNA, 16 bp, Artificial Sequence
  synthetic [barcode part1]
gactatacggcgtgtt

SEQ ID NO: 30308 - DNA, 16 bp, Artificial Sequence
  synthetic [barcode part1]
tacacagagtggtggc

SEQ ID NO: 30309 - DNA, 16 bp, Artificial Sequence
  synthetic [barcode part1]
gtgcgacttcctcaac

SEQ ID NO: 30310 - DNA, 16 bp, Artificial Sequence
  synthetic [barcode part1]
cgtaggtcaccgtctt

SEQ ID NO: 30311 - DNA, 16 bp, Artificial Sequence
  synthetic [barcode part1]
gtggccaccttaactc

SEQ ID NO: 30312 - DNA, 16 bp, Artificial Sequence
  synthetic [barcode part1]
tgcgaatctgtcctgc

SEQ ID NO: 30313 - DNA, 16 bp, Artificial Sequence
  synthetic [barcode part1]
tctctggcacgatcac

SEQ ID NO: 30314 - DNA, 16 bp, Artificial Sequence
  synthetic [barcode part1]
tgtgtaggccttccac

SEQ ID NO: 30315 - DNA, 16 bp, Artificial Sequence
  synthetic [barcode part1]
cacgaagtaacaactg

SEQ ID NO: 30316 - DNA, 16 bp, Artificial Sequence
  synthetic [barcode part1]
gactcagattaggcct

SEQ ID NO: 30317 - DNA, 16 bp, Artificial Sequence
  synthetic [barcode part1]
ttggataggacggcgt

SEQ ID NO: 30318 - DNA, 16 bp, Artificial Sequence
  synthetic [barcode part1]
caagtcaacgttcttc

SEQ ID NO: 30319 - DNA, 16 bp, Artificial Sequence
  synthetic [barcode part1]
tgttgcaagtctcgag

SEQ ID NO: 30320 - DNA, 16 bp, Artificial Sequence
  synthetic [barcode part1]
gttcggatcactccgt

SEQ ID NO: 30321 - DNA, 16 bp, Artificial Sequence
  synthetic [barcode part1]
tgtcagtacactggtg

SEQ ID NO: 30322 - DNA, 16 bp, Artificial Sequence
  synthetic [barcode part1]
tctgccggttgttctt

SEQ ID NO: 30323 - DNA, 16 bp, Artificial Sequence
  synthetic [barcode part1]
cagtaaccggtctaac

SEQ ID NO: 30324 - DNA, 16 bp, Artificial Sequence
  synthetic [barcode part1]
gacgtccggtatattg

SEQ ID NO: 30325 - DNA, 16 bp, Artificial Sequence
  synthetic [barcode part1]
tatcgttcggattcac

SEQ ID NO: 30326 - DNA, 16 bp, Artificial Sequence
  synthetic [barcode part1]
gcgttctcgtatcttc

SEQ ID NO: 30327 - DNA, 16 bp, Artificial Sequence
  synthetic [barcode part1]
tggcagacttattgcg

SEQ ID NO: 30328 - DNA, 16 bp, Artificial Sequence
  synthetic [barcode part1]
attaggaggtccttcg

SEQ ID NO: 30329 - DNA, 16 bp, Artificial Sequence
  synthetic [barcode part1]
acggttgttctagtct

SEQ ID NO: 30330 - DNA, 16 bp, Artificial Sequence
  synthetic [barcode part1]
acttctgcggattact

SEQ ID NO: 30331 - DNA, 16 bp, Artificial Sequence
  synthetic [barcode part1]
cgagattggtcaatcc

SEQ ID NO: 30332 - DNA, 16 bp, Artificial Sequence
  synthetic [barcode part1]
gaattacggcgactct

SEQ ID NO: 30333 - DNA, 16 bp, Artificial Sequence
  synthetic [barcode part1]
tattggacctgtacct

SEQ ID NO: 30334 - DNA, 16 bp, Artificial Sequence
  synthetic [barcode part1]
tccggtcaccggtatt

SEQ ID NO: 30335 - DNA, 16 bp, Artificial Sequence
  synthetic [barcode part1]
tggagagtaacgcacc

SEQ ID NO: 30336 - DNA, 16 bp, Artificial Sequence
  synthetic [barcode part1]
cctcacagactatcgc

SEQ ID NO: 30337 - DNA, 16 bp, Artificial Sequence
  synthetic [barcode part1]
gagtaagtgtccgtct

SEQ ID NO: 30338 - DNA, 16 bp, Artificial Sequence
  synthetic [barcode part1]
cggagttccttcttct

SEQ ID NO: 30339 - DNA, 16 bp, Artificial Sequence
  synthetic [barcode part1]
aatcctcctagtacgt

SEQ ID NO: 30340 - DNA, 16 bp, Artificial Sequence
  synthetic [barcode part1]
gtggtgtatcgatcgt

SEQ ID NO: 30341 - DNA, 16 bp, Artificial Sequence
  synthetic [barcode part1]
tgagactcacagtgtc

SEQ ID NO: 30342 - DNA, 16 bp, Artificial Sequence
  synthetic [barcode part1]
ccacgtgagttggaag

SEQ ID NO: 30343 - DNA, 16 bp, Artificial Sequence
  synthetic [barcode part1]
gattacgtcttgatcc

SEQ ID NO: 30344 - DNA, 16 bp, Artificial Sequence
  synthetic [barcode part1]
aggtaaggttctgagt

SEQ ID NO: 30345 - DNA, 16 bp, Artificial Sequence
  synthetic [barcode part1]
agaaggttactggtgt

SEQ ID NO: 30346 - DNA, 16 bp, Artificial Sequence
  synthetic [barcode part1]
gtctgcctgaggtctt

SEQ ID NO: 30347 - DNA, 16 bp, Artificial Sequence
  synthetic [barcode part1]
acttgactgcactccg

SEQ ID NO: 30348 - DNA, 16 bp, Artificial Sequence
  synthetic [barcode part1]
ttgtggttggtcaacg

SEQ ID NO: 30349 - DNA, 16 bp, Artificial Sequence
  synthetic [barcode part1]
ttaacggccgcacttc

SEQ ID NO: 30350 - DNA, 16 bp, Artificial Sequence
  synthetic [barcode part1]
tacgacacagaacctc

SEQ ID NO: 30351 - DNA, 16 bp, Artificial Sequence
  synthetic [barcode part1]
agacgtcagacctgtt

SEQ ID NO: 30352 - DNA, 16 bp, Artificial Sequence
  synthetic [barcode part1]
caggacacagacctag

SEQ ID NO: 30353 - DNA, 16 bp, Artificial Sequence
  synthetic [barcode part1]
attcgttaagtctcgc

SEQ ID NO: 30354 - DNA, 16 bp, Artificial Sequence
  synthetic [barcode part1]
ttgacttgcctaagtc

SEQ ID NO: 30355 - DNA, 16 bp, Artificial Sequence
  synthetic [barcode part1]
ttaggtgtaaggtgac

SEQ ID NO: 30356 - DNA, 16 bp, Artificial Sequence
  synthetic [barcode part1]
cactcctctaagttag

SEQ ID NO: 30357 - DNA, 16 bp, Artificial Sequence
  synthetic [barcode part1]
tgaagatcgagttacg

SEQ ID NO: 30358 - DNA, 16 bp, Artificial Sequence
  synthetic [barcode part1]
agttcactagacgtcg

SEQ ID NO: 30359 - DNA, 16 bp, Artificial Sequence
  synthetic [barcode part1]
tccaccgacgcaactt

SEQ ID NO: 30360 - DNA, 16 bp, Artificial Sequence
  synthetic [barcode part1]
taagtccaggtctacg

SEQ ID NO: 30361 - DNA, 16 bp, Artificial Sequence
  synthetic [barcode part1]
cactctgtagatactc

SEQ ID NO: 30362 - DNA, 16 bp, Artificial Sequence
  synthetic [barcode part1]
tagagtccgtatacgc

SEQ ID NO: 30363 - DNA, 16 bp, Artificial Sequence
  synthetic [barcode part1]
gtaactggtgtatcgc

SEQ ID NO: 30364 - DNA, 16 bp, Artificial Sequence
  synthetic [barcode part1]
atctcttcacacagtg

SEQ ID NO: 30365 - DNA, 16 bp, Artificial Sequence
  synthetic [barcode part1]
gccagtactcagtcct

SEQ ID NO: 30366 - DNA, 16 bp, Artificial Sequence
  synthetic [barcode part1]
gtctcgtgtaactatc

SEQ ID NO: 30367 - DNA, 16 bp, Artificial Sequence
  synthetic [barcode part1]
ccgaagaacacctgag

SEQ ID NO: 30368 - DNA, 16 bp, Artificial Sequence
  synthetic [barcode part1]
ttatcgtgcgaacttc

SEQ ID NO: 30369 - DNA, 16 bp, Artificial Sequence
  synthetic [barcode part1]
gcgttgaggtcgtatt

SEQ ID NO: 30370 - DNA, 16 bp, Artificial Sequence
  synthetic [barcode part1]
agagtggaagtagtgc

SEQ ID NO: 30371 - DNA, 16 bp, Artificial Sequence
  synthetic [barcode part1]
cggcaacgtactcttc

SEQ ID NO: 30372 - DNA, 16 bp, Artificial Sequence
  synthetic [barcode part1]
gtggtcacacagttgt

SEQ ID NO: 30373 - DNA, 16 bp, Artificial Sequence
  synthetic [barcode part1]
gatcgtacacagttgc

SEQ ID NO: 30374 - DNA, 16 bp, Artificial Sequence
  synthetic [barcode part1]
gacacgcgagagattc

SEQ ID NO: 30375 - DNA, 16 bp, Artificial Sequence
  synthetic [barcode part1]
acttccacggattgtt

SEQ ID NO: 30376 - DNA, 16 bp, Artificial Sequence
  synthetic [barcode part1]
cgcagtgagtgagtac

SEQ ID NO: 30377 - DNA, 16 bp, Artificial Sequence
  synthetic [barcode part1]
gcgaagtcgttcagag

SEQ ID NO: 30378 - DNA, 16 bp, Artificial Sequence
  synthetic [barcode part1]
tgcctatccactcgtt

SEQ ID NO: 30379 - DNA, 16 bp, Artificial Sequence
  synthetic [barcode part1]
cagataactcgcctag

SEQ ID NO: 30380 - DNA, 16 bp, Artificial Sequence
  synthetic [barcode part1]
agttcgaccaacagtc

SEQ ID NO: 30381 - DNA, 16 bp, Artificial Sequence
  synthetic [barcode part1]
ccaggattccgaagtt

SEQ ID NO: 30382 - DNA, 16 bp, Artificial Sequence
  synthetic [barcode part1]
tcttctcaccgtaacc

SEQ ID NO: 30383 - DNA, 16 bp, Artificial Sequence
  synthetic [barcode part1]
tctagttcggtgcgtc

SEQ ID NO: 30384 - DNA, 16 bp, Artificial Sequence
  synthetic [barcode part1]
tctccgtaacgacctg

SEQ ID NO: 30385 - DNA, 16 bp, Artificial Sequence
  synthetic [barcode part1]
cgttcactgaacagac

SEQ ID NO: 30386 - DNA, 16 bp, Artificial Sequence
  synthetic [barcode part1]
tgcgacactatctgtt

SEQ ID NO: 30387 - DNA, 16 bp, Artificial Sequence
  synthetic [barcode part1]
tcaacttgtgagacgc

SEQ ID NO: 30388 - DNA, 16 bp, Artificial Sequence
  synthetic [barcode part1]
gcaccagttaggtatc

SEQ ID NO: 30389 - DNA, 16 bp, Artificial Sequence
  synthetic [barcode part1]
gcggactaagaatcgc

SEQ ID NO: 30390 - DNA, 16 bp, Artificial Sequence
  synthetic [barcode part1]
tgcggacagtaagacc

SEQ ID NO: 30391 - DNA, 16 bp, Artificial Sequence
  synthetic [barcode part1]
cctaaccgccgtatac

SEQ ID NO: 30392 - DNA, 16 bp, Artificial Sequence
  synthetic [barcode part1]
agaactcactcacttc

SEQ ID NO: 30393 - DNA, 16 bp, Artificial Sequence
  synthetic [barcode part1]
acacgaccgtgattgt

SEQ ID NO: 30394 - DNA, 16 bp, Artificial Sequence
  synthetic [barcode part1]
gtctctggtggtctac

SEQ ID NO: 30395 - DNA, 16 bp, Artificial Sequence
  synthetic [barcode part1]
ccaccagaatctagtg

SEQ ID NO: 30396 - DNA, 16 bp, Artificial Sequence
  synthetic [barcode part1]
tgccacgtaactaacg

SEQ ID NO: 30397 - DNA, 16 bp, Artificial Sequence
  synthetic [barcode part1]
cgtacagttcaactct

SEQ ID NO: 30398 - DNA, 16 bp, Artificial Sequence
  synthetic [barcode part1]
aacaagtacggtgttg

SEQ ID NO: 30399 - DNA, 16 bp, Artificial Sequence
  synthetic [barcode part1]
attaggttccgtacct

SEQ ID NO: 30400 - DNA, 16 bp, Artificial Sequence
  synthetic [barcode part1]
gtctccgacttgacgt

SEQ ID NO: 30401 - DNA, 16 bp, Artificial Sequence
  synthetic [barcode part1]
aacacctctcacagag

SEQ ID NO: 30402 - DNA, 16 bp, Artificial Sequence
  synthetic [barcode part1]
acttcactcgtacagt

SEQ ID NO: 30403 - DNA, 16 bp, Artificial Sequence
  synthetic [barcode part1]
agtccttatacctggt

SEQ ID NO: 30404 - DNA, 16 bp, Artificial Sequence
  synthetic [barcode part1]
gcgattgtcctggtct

SEQ ID NO: 30405 - DNA, 16 bp, Artificial Sequence
  synthetic [barcode part1]
acgttgaacgcaatcc

SEQ ID NO: 30406 - DNA, 16 bp, Artificial Sequence
  synthetic [barcode part1]
aaggttagtcgtctcg

SEQ ID NO: 30407 - DNA, 16 bp, Artificial Sequence
  synthetic [barcode part1]
gcgttaggtcgtctct

SEQ ID NO: 30408 - DNA, 16 bp, Artificial Sequence
  synthetic [barcode part1]
tgcgagtgacaagatt

SEQ ID NO: 30409 - DNA, 16 bp, Artificial Sequence
  synthetic [barcode part1]
tcgactcctcacgaac

SEQ ID NO: 30410 - DNA, 16 bp, Artificial Sequence
  synthetic [barcode part1]
tactaatcggcgtgtg

SEQ ID NO: 30411 - DNA, 16 bp, Artificial Sequence
  synthetic [barcode part1]
tgcggtcggaatagtg

SEQ ID NO: 30412 - DNA, 16 bp, Artificial Sequence
  synthetic [barcode part1]
ttcggaagtcgtaacc

SEQ ID NO: 30413 - DNA, 16 bp, Artificial Sequence
  synthetic [barcode part1]
caagtattctccgact

SEQ ID NO: 30414 - DNA, 16 bp, Artificial Sequence
  synthetic [barcode part1]
ccgactccactagtgt

SEQ ID NO: 30415 - DNA, 16 bp, Artificial Sequence
  synthetic [barcode part1]
acagtgcgagattcct

SEQ ID NO: 30416 - DNA, 16 bp, Artificial Sequence
  synthetic [barcode part1]
gcaccgatagttctcc

SEQ ID NO: 30417 - DNA, 16 bp, Artificial Sequence
  synthetic [barcode part1]
agtaggcgtaacgtcg

SEQ ID NO: 30418 - DNA, 16 bp, Artificial Sequence
  synthetic [barcode part1]
caagtcgagaggtatt

SEQ ID NO: 30419 - DNA, 16 bp, Artificial Sequence
  synthetic [barcode part1]
acacactatccaggtg

SEQ ID NO: 30420 - DNA, 16 bp, Artificial Sequence
  synthetic [barcode part1]
acgcctcactggatct

SEQ ID NO: 30421 - DNA, 16 bp, Artificial Sequence
  synthetic [barcode part1]
cctggtccgtgtgatt

SEQ ID NO: 30422 - DNA, 16 bp, Artificial Sequence
  synthetic [barcode part1]
gttacctggacttact

SEQ ID NO: 30423 - DNA, 16 bp, Artificial Sequence
  synthetic [barcode part1]
gccacagtctatccac

SEQ ID NO: 30424 - DNA, 16 bp, Artificial Sequence
  synthetic [barcode part1]
acagaggtcagactgc

SEQ ID NO: 30425 - DNA, 16 bp, Artificial Sequence
  synthetic [barcode part1]
ttgtcgttcgtcctgt

SEQ ID NO: 30426 - DNA, 16 bp, Artificial Sequence
  synthetic [barcode part1]
caggaggcgtaatcgt

SEQ ID NO: 30427 - DNA, 16 bp, Artificial Sequence
  synthetic [barcode part1]
cgaaggttctacgttg

SEQ ID NO: 30428 - DNA, 16 bp, Artificial Sequence
  synthetic [barcode part1]
ttcacacgactgccgt

SEQ ID NO: 30429 - DNA, 16 bp, Artificial Sequence
  synthetic [barcode part1]
aggtctgttcgatctt

SEQ ID NO: 30430 - DNA, 16 bp, Artificial Sequence
  synthetic [barcode part1]
tgagtggcctacttag

SEQ ID NO: 30431 - DNA, 16 bp, Artificial Sequence
  synthetic [barcode part1]
accgataaccttccgc

SEQ ID NO: 30432 - DNA, 16 bp, Artificial Sequence
  synthetic [barcode part1]
tgttctaccacaggcc

SEQ ID NO: 30433 - DNA, 16 bp, Artificial Sequence
  synthetic [barcode part1]
aataggaggtcgtgcc

SEQ ID NO: 30434 - DNA, 16 bp, Artificial Sequence
  synthetic [barcode part1]
aggccactgttaagtc

SEQ ID NO: 30435 - DNA, 16 bp, Artificial Sequence
  synthetic [barcode part1]
tacacgttgtgacgtg

SEQ ID NO: 30436 - DNA, 16 bp, Artificial Sequence
  synthetic [barcode part1]
cggaagaccaatcttc

SEQ ID NO: 30437 - DNA, 16 bp, Artificial Sequence
  synthetic [barcode part1]
tagagttcgtgcacgt

SEQ ID NO: 30438 - DNA, 16 bp, Artificial Sequence
  synthetic [barcode part1]
taagacctagtcggtc

SEQ ID NO: 30439 - DNA, 16 bp, Artificial Sequence
  synthetic [barcode part1]
gaaggacaagtacttc

SEQ ID NO: 30440 - DNA, 16 bp, Artificial Sequence
  synthetic [barcode part1]
agtcgagaagtcgaag

SEQ ID NO: 30441 - DNA, 16 bp, Artificial Sequence
  synthetic [barcode part1]
ataagtggtgacgttg

SEQ ID NO: 30442 - DNA, 16 bp, Artificial Sequence
  synthetic [barcode part1]
tctcgattgcagactt

SEQ ID NO: 30443 - DNA, 16 bp, Artificial Sequence
  synthetic [barcode part1]
caacacacgtattggc

SEQ ID NO: 30444 - DNA, 16 bp, Artificial Sequence
  synthetic [barcode part1]
ttccggtgattgcgtc

SEQ ID NO: 30445 - DNA, 16 bp, Artificial Sequence
  synthetic [barcode part1]
aagtaccggtgtctac

SEQ ID NO: 30446 - DNA, 16 bp, Artificial Sequence
  synthetic [barcode part1]
ccagtagagacacggt

SEQ ID NO: 30447 - DNA, 16 bp, Artificial Sequence
  synthetic [barcode part1]
gaagttatcctcgacg

SEQ ID NO: 30448 - DNA, 16 bp, Artificial Sequence
  synthetic [barcode part1]
atcacgttacgccaag

SEQ ID NO: 30449 - DNA, 16 bp, Artificial Sequence
  synthetic [barcode part1]
gccttgttaggtccac

SEQ ID NO: 30450 - DNA, 16 bp, Artificial Sequence
  synthetic [barcode part1]
ataaggaccgataacc

SEQ ID NO: 30451 - DNA, 16 bp, Artificial Sequence
  synthetic [barcode part1]
cagacttgaacttgcg

SEQ ID NO: 30452 - DNA, 16 bp, Artificial Sequence
  synthetic [barcode part1]
acgttactgcctattg

SEQ ID NO: 30453 - DNA, 16 bp, Artificial Sequence
  synthetic [barcode part1]
ttgtgaccacacacag

SEQ ID NO: 30454 - DNA, 16 bp, Artificial Sequence
  synthetic [barcode part1]
cgaggaggttgatatt

SEQ ID NO: 30455 - DNA, 16 bp, Artificial Sequence
  synthetic [barcode part1]
gattcgactccacacc

SEQ ID NO: 30456 - DNA, 16 bp, Artificial Sequence
  synthetic [barcode part1]
tgtctcgatctcactc

SEQ ID NO: 30457 - DNA, 16 bp, Artificial Sequence
  synthetic [barcode part1]
atctactaacgtcacc

SEQ ID NO: 30458 - DNA, 16 bp, Artificial Sequence
  synthetic [barcode part1]
gttcgccaagtggatt

SEQ ID NO: 30459 - DNA, 16 bp, Artificial Sequence
  synthetic [barcode part1]
tcggttaaggactctg

SEQ ID NO: 30460 - DNA, 16 bp, Artificial Sequence
  synthetic [barcode part1]
caagttcagatccacg

SEQ ID NO: 30461 - DNA, 16 bp, Artificial Sequence
  synthetic [barcode part1]
aggacaacgaggtagt

SEQ ID NO: 30462 - DNA, 16 bp, Artificial Sequence
  synthetic [barcode part1]
agattgcgtctaacgc

SEQ ID NO: 30463 - DNA, 16 bp, Artificial Sequence
  synthetic [barcode part1]
gcgtctgtaccacttg

SEQ ID NO: 30464 - DNA, 16 bp, Artificial Sequence
  synthetic [barcode part1]
cgttccaagtatctac

SEQ ID NO: 30465 - DNA, 16 bp, Artificial Sequence
  synthetic [barcode part1]
gactgaccacaacact

SEQ ID NO: 30466 - DNA, 16 bp, Artificial Sequence
  synthetic [barcode part1]
actctaggttgcagtg

SEQ ID NO: 30467 - DNA, 16 bp, Artificial Sequence
  synthetic [barcode part1]
actgcaataggtgaac

SEQ ID NO: 30468 - DNA, 16 bp, Artificial Sequence
  synthetic [barcode part1]
gcagattagttcacgc

SEQ ID NO: 30469 - DNA, 16 bp, Artificial Sequence
  synthetic [barcode part1]
aatccttaccgtctcc

SEQ ID NO: 30470 - DNA, 16 bp, Artificial Sequence
  synthetic [barcode part1]
cgcgtctcttgtactt

SEQ ID NO: 30471 - DNA, 16 bp, Artificial Sequence
  synthetic [barcode part1]
agttcctgtattcggt

SEQ ID NO: 30472 - DNA, 16 bp, Artificial Sequence
  synthetic [barcode part1]
agtcactgcagagacg

SEQ ID NO: 30473 - DNA, 16 bp, Artificial Sequence
  synthetic [barcode part1]
agtaattcctcgtacc

SEQ ID NO: 30474 - DNA, 16 bp, Artificial Sequence
  synthetic [barcode part1]
gtacctacacttggag

SEQ ID NO: 30475 - DNA, 16 bp, Artificial Sequence
  synthetic [barcode part1]
taattgagtgccacgc

SEQ ID NO: 30476 - DNA, 16 bp, Artificial Sequence
  synthetic [barcode part1]
gtccgaactatcttgt

SEQ ID NO: 30477 - DNA, 16 bp, Artificial Sequence
  synthetic [barcode part1]
acaaccgttagagagt

SEQ ID NO: 30478 - DNA, 16 bp, Artificial Sequence
  synthetic [barcode part1]
tagactggaggtgcac

SEQ ID NO: 30479 - DNA, 16 bp, Artificial Sequence
  synthetic [barcode part1]
gcctattcaggattct

SEQ ID NO: 30480 - DNA, 16 bp, Artificial Sequence
  synthetic [barcode part1]
cgtggattctactgtt

SEQ ID NO: 30481 - DNA, 16 bp, Artificial Sequence
  synthetic [barcode part1]
cagtcaatacacgtgc

SEQ ID NO: 30482 - DNA, 16 bp, Artificial Sequence
  synthetic [barcode part1]
gtcacggacggataac

SEQ ID NO: 30483 - DNA, 16 bp, Artificial Sequence
  synthetic [barcode part1]
gttgaacacttgacgc

SEQ ID NO: 30484 - DNA, 16 bp, Artificial Sequence
  synthetic [barcode part1]
gcgatcgtcttgactc

SEQ ID NO: 30485 - DNA, 16 bp, Artificial Sequence
  synthetic [barcode part1]
gtacaattctcgacct

SEQ ID NO: 30486 - DNA, 16 bp, Artificial Sequence
  synthetic [barcode part1]
atacacggagatctcc

SEQ ID NO: 30487 - DNA, 16 bp, Artificial Sequence
  synthetic [barcode part1]
atccttaccacactcc

SEQ ID NO: 30488 - DNA, 16 bp, Artificial Sequence
  synthetic [barcode part1]
aagaacgaacggtctt

SEQ ID NO: 30489 - DNA, 16 bp, Artificial Sequence
  synthetic [barcode part1]
ttcacgcaccggattc

SEQ ID NO: 30490 - DNA, 16 bp, Artificial Sequence
  synthetic [barcode part1]
gtgaacgtacttgtcg

SEQ ID NO: 30491 - DNA, 16 bp, Artificial Sequence
  synthetic [barcode part1]
ttgaccactgaagtcg

SEQ ID NO: 30492 - DNA, 16 bp, Artificial Sequence
  synthetic [barcode part1]
gttcaacagaacacag

SEQ ID NO: 30493 - DNA, 16 bp, Artificial Sequence
  synthetic [barcode part1]
tcactgttagacgtct

SEQ ID NO: 30494 - DNA, 16 bp, Artificial Sequence
  synthetic [barcode part1]
cgtcgactcctagttg

SEQ ID NO: 30495 - DNA, 16 bp, Artificial Sequence
  synthetic [barcode part1]
ttcgttagattcacgc

SEQ ID NO: 30496 - DNA, 16 bp, Artificial Sequence
  synthetic [barcode part1]
atctggtcgatccaag

SEQ ID NO: 30497 - DNA, 16 bp, Artificial Sequence
  synthetic [barcode part1]
tgcaaggttagactag

SEQ ID NO: 30498 - DNA, 16 bp, Artificial Sequence
  synthetic [barcode part1]
ccggactcgtatcttg

SEQ ID NO: 30499 - DNA, 16 bp, Artificial Sequence
  synthetic [barcode part1]
tcaacagaggtacaac

SEQ ID NO: 30500 - DNA, 16 bp, Artificial Sequence
  synthetic [barcode part1]
atcctcgaacgtagac

SEQ ID NO: 30501 - DNA, 16 bp, Artificial Sequence
  synthetic [barcode part1]
tctggttactggtgtt

SEQ ID NO: 30502 - DNA, 16 bp, Artificial Sequence
  synthetic [barcode part1]
gagttggcaacacacg

SEQ ID NO: 30503 - DNA, 16 bp, Artificial Sequence
  synthetic [barcode part1]
atcggtaaggtacctc

SEQ ID NO: 30504 - DNA, 16 bp, Artificial Sequence
  synthetic [barcode part1]
ttagacgtattgcctc

SEQ ID NO: 30505 - DNA, 16 bp, Artificial Sequence
  synthetic [barcode part1]
ttgagactggagtctc

SEQ ID NO: 30506 - DNA, 16 bp, Artificial Sequence
  synthetic [barcode part1]
ataggatcaccactcg

SEQ ID NO: 30507 - DNA, 16 bp, Artificial Sequence
  synthetic [barcode part1]
ccgagaagttgagaag

SEQ ID NO: 30508 - DNA, 16 bp, Artificial Sequence
  synthetic [barcode part1]
caatattgcaggcaag

SEQ ID NO: 30509 - DNA, 16 bp, Artificial Sequence
  synthetic [barcode part1]
tgtccactactcgttc

SEQ ID NO: 30510 - DNA, 16 bp, Artificial Sequence
  synthetic [barcode part1]
cgcacttgtgactcac

SEQ ID NO: 30511 - DNA, 16 bp, Artificial Sequence
  synthetic [barcode part1]
atatacttggaaggcg

SEQ ID NO: 30512 - DNA, 16 bp, Artificial Sequence
  synthetic [barcode part1]
gagtagaaggcgaact

SEQ ID NO: 30513 - DNA, 16 bp, Artificial Sequence
  synthetic [barcode part1]
gcaggttagaacagtt

SEQ ID NO: 30514 - DNA, 16 bp, Artificial Sequence
  synthetic [barcode part1]
acactcctcagatcgc

SEQ ID NO: 30515 - DNA, 16 bp, Artificial Sequence
  synthetic [barcode part1]
tcggacctgtatcctg

SEQ ID NO: 30516 - DNA, 16 bp, Artificial Sequence
  synthetic [barcode part1]
gtgaggactctatacc

SEQ ID NO: 30517 - DNA, 16 bp, Artificial Sequence
  synthetic [barcode part1]
gtccaatatactctcg

SEQ ID NO: 30518 - DNA, 16 bp, Artificial Sequence
  synthetic [barcode part1]
acagaatcctaccgtg

SEQ ID NO: 30519 - DNA, 16 bp, Artificial Sequence
  synthetic [barcode part1]
cacaatccaatctctg

SEQ ID NO: 30520 - DNA, 16 bp, Artificial Sequence
  synthetic [barcode part1]
tacagacaacggaatc

SEQ ID NO: 30521 - DNA, 16 bp, Artificial Sequence
  synthetic [barcode part1]
cgttatcctcgcaggt

SEQ ID NO: 30522 - DNA, 16 bp, Artificial Sequence
  synthetic [barcode part1]
ccgttatcacttgagt

SEQ ID NO: 30523 - DNA, 16 bp, Artificial Sequence
  synthetic [barcode part1]
tgaagtcgtcaactgc

SEQ ID NO: 30524 - DNA, 16 bp, Artificial Sequence
  synthetic [barcode part1]
tgaacggtcacttacg

SEQ ID NO: 30525 - DNA, 16 bp, Artificial Sequence
  synthetic [barcode part1]
tcgtacactaacttcg

SEQ ID NO: 30526 - DNA, 16 bp, Artificial Sequence
  synthetic [barcode part1]
tgtctatcgtcacaac

SEQ ID NO: 30527 - DNA, 16 bp, Artificial Sequence
  synthetic [barcode part1]
tgtgcgagttcaggtt

SEQ ID NO: 30528 - DNA, 16 bp, Artificial Sequence
  synthetic [barcode part1]
cctaccactgacacac

SEQ ID NO: 30529 - DNA, 16 bp, Artificial Sequence
  synthetic [barcode part1]
cctcggaactcacttg

SEQ ID NO: 30530 - DNA, 16 bp, Artificial Sequence
  synthetic [barcode part1]
gtgttgatagtaaggc

SEQ ID NO: 30531 - DNA, 16 bp, Artificial Sequence
  synthetic [barcode part1]
cggtattgtctcagag

SEQ ID NO: 30532 - DNA, 16 bp, Artificial Sequence
  synthetic [barcode part1]
ttacaggtccaatctc

SEQ ID NO: 30533 - DNA, 16 bp, Artificial Sequence
  synthetic [barcode part1]
gacaaggtgtactggc

SEQ ID NO: 30534 - DNA, 16 bp, Artificial Sequence
  synthetic [barcode part1]
cgttggacagagacgt

SEQ ID NO: 30535 - DNA, 16 bp, Artificial Sequence
  synthetic [barcode part1]
tgcactcactcgacac

SEQ ID NO: 30536 - DNA, 16 bp, Artificial Sequence
  synthetic [barcode part1]
cagacgaacgatattg

SEQ ID NO: 30537 - DNA, 16 bp, Artificial Sequence
  synthetic [barcode part1]
ttgtgtcgcaggaact

SEQ ID NO: 30538 - DNA, 16 bp, Artificial Sequence
  synthetic [barcode part1]
tacggcgatcttgaac

SEQ ID NO: 30539 - DNA, 16 bp, Artificial Sequence
  synthetic [barcode part1]
gtccgcagttatcctg

SEQ ID NO: 30540 - DNA, 16 bp, Artificial Sequence
  synthetic [barcode part1]
tcaggtggatactcgt

SEQ ID NO: 30541 - DNA, 16 bp, Artificial Sequence
  synthetic [barcode part1]
tcagacgtagaacagt

SEQ ID NO: 30542 - DNA, 16 bp, Artificial Sequence
  synthetic [barcode part1]
tgaaccggattcgact

SEQ ID NO: 30543 - DNA, 16 bp, Artificial Sequence
  synthetic [barcode part1]
gttctatcagatccac

SEQ ID NO: 30544 - DNA, 16 bp, Artificial Sequence
  synthetic [barcode part1]
caaggaagtcgatact

SEQ ID NO: 30545 - DNA, 16 bp, Artificial Sequence
  synthetic [barcode part1]
aggtcgtgcgagaact

SEQ ID NO: 30546 - DNA, 16 bp, Artificial Sequence
  synthetic [barcode part1]
atcttaacgcgcacag

SEQ ID NO: 30547 - DNA, 16 bp, Artificial Sequence
  synthetic [barcode part1]
tcctgactgtgccaac

SEQ ID NO: 30548 - DNA, 16 bp, Artificial Sequence
  synthetic [barcode part1]
tacctcactgtagact

SEQ ID NO: 30549 - DNA, 16 bp, Artificial Sequence
  synthetic [barcode part1]
gcagaccaaggatcac

SEQ ID NO: 30550 - DNA, 16 bp, Artificial Sequence
  synthetic [barcode part1]
accgcagacaatactc

SEQ ID NO: 30551 - DNA, 16 bp, Artificial Sequence
  synthetic [barcode part1]
gcggtattaaccggtt

SEQ ID NO: 30552 - DNA, 16 bp, Artificial Sequence
  synthetic [barcode part1]
cgatagtgaagtgtac

SEQ ID NO: 30553 - DNA, 16 bp, Artificial Sequence
  synthetic [barcode part1]
ataccagttcctaacc

SEQ ID NO: 30554 - DNA, 16 bp, Artificial Sequence
  synthetic [barcode part1]
gcgtctcaactcgact

SEQ ID NO: 30555 - DNA, 16 bp, Artificial Sequence
  synthetic [barcode part1]
gagtgttcctggatac

SEQ ID NO: 30556 - DNA, 16 bp, Artificial Sequence
  synthetic [barcode part1]
gttggtgagtacacct

SEQ ID NO: 30557 - DNA, 16 bp, Artificial Sequence
  synthetic [barcode part1]
tcgcgttgcagttcac

SEQ ID NO: 30558 - DNA, 16 bp, Artificial Sequence
  synthetic [barcode part1]
acggaggttctgtgtt

SEQ ID NO: 30559 - DNA, 16 bp, Artificial Sequence
  synthetic [barcode part1]
agaagacgcggtcact

SEQ ID NO: 30560 - DNA, 16 bp, Artificial Sequence
  synthetic [barcode part1]
ttggtgtgtaccaacg

SEQ ID NO: 30561 - DNA, 16 bp, Artificial Sequence
  synthetic [barcode part1]
aacagtattcgccgtg

SEQ ID NO: 30562 - DNA, 16 bp, Artificial Sequence
  synthetic [barcode part1]
tagtacaggaacggtt

SEQ ID NO: 30563 - DNA, 16 bp, Artificial Sequence
  synthetic [barcode part1]
taccgaaggtaacctc

SEQ ID NO: 30564 - DNA, 16 bp, Artificial Sequence
  synthetic [barcode part1]
actgtcacgatccaag

SEQ ID NO: 30565 - DNA, 16 bp, Artificial Sequence
  synthetic [barcode part1]
taactcgccactgaag

SEQ ID NO: 30566 - DNA, 16 bp, Artificial Sequence
  synthetic [barcode part1]
tcctctggtctagacg

SEQ ID NO: 30567 - DNA, 16 bp, Artificial Sequence
  synthetic [barcode part1]
agaggcgtctaacggt

SEQ ID NO: 30568 - DNA, 16 bp, Artificial Sequence
  synthetic [barcode part1]
accaccgtaacgattg

SEQ ID NO: 30569 - DNA, 16 bp, Artificial Sequence
  synthetic [barcode part1]
tgaagaagtacgtcac

SEQ ID NO: 30570 - DNA, 16 bp, Artificial Sequence
  synthetic [barcode part1]
ataccactgttgcgag

SEQ ID NO: 30571 - DNA, 16 bp, Artificial Sequence
  synthetic [barcode part1]
tcgacaacactagacc

SEQ ID NO: 30572 - DNA, 16 bp, Artificial Sequence
  synthetic [barcode part1]
gtgtgttggtacgttg

SEQ ID NO: 30573 - DNA, 16 bp, Artificial Sequence
  synthetic [barcode part1]
gtacttcgcgttctct

SEQ ID NO: 30574 - DNA, 16 bp, Artificial Sequence
  synthetic [barcode part1]
gttgtaacaggcaagt

SEQ ID NO: 30575 - DNA, 16 bp, Artificial Sequence
  synthetic [barcode part1]
tcacgaggttcgaact

SEQ ID NO: 30576 - DNA, 16 bp, Artificial Sequence
  synthetic [barcode part1]
acctgaatcacagacc

SEQ ID NO: 30577 - DNA, 16 bp, Artificial Sequence
  synthetic [barcode part1]
cgagacagtgagatag

SEQ ID NO: 30578 - DNA, 16 bp, Artificial Sequence
  synthetic [barcode part1]
cctctaacgtggtcgt

SEQ ID NO: 30579 - DNA, 16 bp, Artificial Sequence
  synthetic [barcode part1]
cgtgttacgactgtag

SEQ ID NO: 30580 - DNA, 16 bp, Artificial Sequence
  synthetic [barcode part1]
cgttaactctcgaccg

SEQ ID NO: 30581 - DNA, 16 bp, Artificial Sequence
  synthetic [barcode part1]
gttggcgaatacactc

SEQ ID NO: 30582 - DNA, 16 bp, Artificial Sequence
  synthetic [barcode part1]
cctcagttcagtgcac

SEQ ID NO: 30583 - DNA, 16 bp, Artificial Sequence
  synthetic [barcode part1]
tcttcggcaattacac

SEQ ID NO: 30584 - DNA, 16 bp, Artificial Sequence
  synthetic [barcode part1]
tgtcactcgttccact

SEQ ID NO: 30585 - DNA, 16 bp, Artificial Sequence
  synthetic [barcode part1]
ttaagtaggcaaggtc

SEQ ID NO: 30586 - DNA, 16 bp, Artificial Sequence
  synthetic [barcode part1]
accgaaggagaagttg

SEQ ID NO: 30587 - DNA, 16 bp, Artificial Sequence
  synthetic [barcode part1]
tatagaggccaagttg

SEQ ID NO: 30588 - DNA, 16 bp, Artificial Sequence
  synthetic [barcode part1]
agatccgaacgacggt

SEQ ID NO: 30589 - DNA, 16 bp, Artificial Sequence
  synthetic [barcode part1]
gtagttattccggtct

SEQ ID NO: 30590 - DNA, 16 bp, Artificial Sequence
  synthetic [barcode part1]
tcctgtgaacctaatc

SEQ ID NO: 30591 - DNA, 16 bp, Artificial Sequence
  synthetic [barcode part1]
actcaccgccttagac

SEQ ID NO: 30592 - DNA, 16 bp, Artificial Sequence
  synthetic [barcode part1]
agtggcctcttcgtac

SEQ ID NO: 30593 - DNA, 16 bp, Artificial Sequence
  synthetic [barcode part1]
aggaagactaggatcg

SEQ ID NO: 30594 - DNA, 16 bp, Artificial Sequence
  synthetic [barcode part1]
ttcggaacggttgatc

SEQ ID NO: 30595 - DNA, 16 bp, Artificial Sequence
  synthetic [barcode part1]
attggtgtgtcttgtc

SEQ ID NO: 30596 - DNA, 16 bp, Artificial Sequence
  synthetic [barcode part1]
ttcctcggtagagtag

SEQ ID NO: 30597 - DNA, 16 bp, Artificial Sequence
  synthetic [barcode part1]
cgattaggtcgattgc

SEQ ID NO: 30598 - DNA, 16 bp, Artificial Sequence
  synthetic [barcode part1]
tagtaacggaacgtgt

SEQ ID NO: 30599 - DNA, 16 bp, Artificial Sequence
  synthetic [barcode part1]
gtctctatctacgcct

SEQ ID NO: 30600 - DNA, 16 bp, Artificial Sequence
  synthetic [barcode part1]
gtcgagaatacgccag

SEQ ID NO: 30601 - DNA, 16 bp, Artificial Sequence
  synthetic [barcode part1]
gagaggtcgaatccac

SEQ ID NO: 30602 - DNA, 16 bp, Artificial Sequence
  synthetic [barcode part1]
tgcagttaggacggtg

SEQ ID NO: 30603 - DNA, 16 bp, Artificial Sequence
  synthetic [barcode part1]
acttccgagtggtctc

SEQ ID NO: 30604 - DNA, 16 bp, Artificial Sequence
  synthetic [barcode part1]
tgccgactgtaatcag

SEQ ID NO: 30605 - DNA, 16 bp, Artificial Sequence
  synthetic [barcode part1]
ttgacctgcgaccact

SEQ ID NO: 30606 - DNA, 16 bp, Artificial Sequence
  synthetic [barcode part1]
agaagtaggcaacttc

SEQ ID NO: 30607 - DNA, 16 bp, Artificial Sequence
  synthetic [barcode part1]
gtagttcctcacgtcg

SEQ ID NO: 30608 - DNA, 16 bp, Artificial Sequence
  synthetic [barcode part1]
tccaacagacgtggag

SEQ ID NO: 30609 - DNA, 16 bp, Artificial Sequence
  synthetic [barcode part1]
gccttcgcctatactt

SEQ ID NO: 30610 - DNA, 16 bp, Artificial Sequence
  synthetic [barcode part1]
attggactagatcgcc

SEQ ID NO: 30611 - DNA, 16 bp, Artificial Sequence
  synthetic [barcode part1]
tctggagactgcagtt

SEQ ID NO: 30612 - DNA, 16 bp, Artificial Sequence
  synthetic [barcode part1]
ttggtccgcaatcacc

SEQ ID NO: 30613 - DNA, 16 bp, Artificial Sequence
  synthetic [barcode part1]
taactggaccgtaacc

SEQ ID NO: 30614 - DNA, 16 bp, Artificial Sequence
  synthetic [barcode part1]
taacgaccttcacgcc

SEQ ID NO: 30615 - DNA, 16 bp, Artificial Sequence
  synthetic [barcode part1]
cggtatacgattcttc

SEQ ID NO: 30616 - DNA, 16 bp, Artificial Sequence
  synthetic [barcode part1]
aacctactagacgtcg

SEQ ID NO: 30617 - DNA, 16 bp, Artificial Sequence
  synthetic [barcode part1]
tcttgtgagaacgcgt

SEQ ID NO: 30618 - DNA, 16 bp, Artificial Sequence
  synthetic [barcode part1]
tatattgtggcgcacg

SEQ ID NO: 30619 - DNA, 16 bp, Artificial Sequence
  synthetic [barcode part1]
tgcaacaggtgaatac

SEQ ID NO: 30620 - DNA, 16 bp, Artificial Sequence
  synthetic [barcode part1]
atctctggtctaacgt

SEQ ID NO: 30621 - DNA, 16 bp, Artificial Sequence
  synthetic [barcode part1]
tggtcgattctggagt

SEQ ID NO: 30622 - DNA, 16 bp, Artificial Sequence
  synthetic [barcode part1]
gaccttaagacaggcg

SEQ ID NO: 30623 - DNA, 16 bp, Artificial Sequence
  synthetic [barcode part1]
gtctgtcacctatctc

SEQ ID NO: 30624 - DNA, 16 bp, Artificial Sequence
  synthetic [barcode part1]
aatcagtccggagtct

SEQ ID NO: 30625 - DNA, 16 bp, Artificial Sequence
  synthetic [barcode part1]
tccaactattgcgtgt

SEQ ID NO: 30626 - DNA, 16 bp, Artificial Sequence
  synthetic [barcode part1]
atattccactatcggc

SEQ ID NO: 30627 - DNA, 16 bp, Artificial Sequence
  synthetic [barcode part1]
tgcaggagtattcctg

SEQ ID NO: 30628 - DNA, 16 bp, Artificial Sequence
  synthetic [barcode part1]
aacgtctcctaattcg

SEQ ID NO: 30629 - DNA, 16 bp, Artificial Sequence
  synthetic [barcode part1]
actaccttgaacgtct

SEQ ID NO: 30630 - DNA, 16 bp, Artificial Sequence
  synthetic [barcode part1]
tgttggatatcggacc

SEQ ID NO: 30631 - DNA, 16 bp, Artificial Sequence
  synthetic [barcode part1]
ttgacgactcgcgttc

SEQ ID NO: 30632 - DNA, 16 bp, Artificial Sequence
  synthetic [barcode part1]
cgtagttgttaccttg

SEQ ID NO: 30633 - DNA, 16 bp, Artificial Sequence
  synthetic [barcode part1]
ccgttactactactcc

SEQ ID NO: 30634 - DNA, 16 bp, Artificial Sequence
  synthetic [barcode part1]
gtcactctacctggac

SEQ ID NO: 30635 - DNA, 16 bp, Artificial Sequence
  synthetic [barcode part1]
agattagtaacacgcg

SEQ ID NO: 30636 - DNA, 16 bp, Artificial Sequence
  synthetic [barcode part1]
ccacttacaccgcagt

SEQ ID NO: 30637 - DNA, 16 bp, Artificial Sequence
  synthetic [barcode part1]
acgagagaccgaactc

SEQ ID NO: 30638 - DNA, 16 bp, Artificial Sequence
  synthetic [barcode part1]
cagtgcgtgatcttcc

SEQ ID NO: 30639 - DNA, 16 bp, Artificial Sequence
  synthetic [barcode part1]
gaagtatcttcgcgtg

SEQ ID NO: 30640 - DNA, 16 bp, Artificial Sequence
  synthetic [barcode part1]
tgtcctggtgagttcc

SEQ ID NO: 30641 - DNA, 16 bp, Artificial Sequence
  synthetic [barcode part1]
gcagttataaccacgc

SEQ ID NO: 30642 - DNA, 16 bp, Artificial Sequence
  synthetic [barcode part1]
agaagtgtatcggact

SEQ ID NO: 30643 - DNA, 16 bp, Artificial Sequence
  synthetic [barcode part1]
attctactagactcgc

SEQ ID NO: 30644 - DNA, 16 bp, Artificial Sequence
  synthetic [barcode part1]
cgtgtggacggaatac

SEQ ID NO: 30645 - DNA, 16 bp, Artificial Sequence
  synthetic [barcode part1]
tagagtcacgtacgtc

SEQ ID NO: 30646 - DNA, 16 bp, Artificial Sequence
  synthetic [barcode part1]
aattctcctctgccac

SEQ ID NO: 30647 - DNA, 16 bp, Artificial Sequence
  synthetic [barcode part1]
gcaccttgttattgac

SEQ ID NO: 30648 - DNA, 16 bp, Artificial Sequence
  synthetic [barcode part1]
caacagtacgttcttc

SEQ ID NO: 30649 - DNA, 16 bp, Artificial Sequence
  synthetic [barcode part1]
cgatacttccgcctag

SEQ ID NO: 30650 - DNA, 16 bp, Artificial Sequence
  synthetic [barcode part1]
aagttcgttatcgtcc

SEQ ID NO: 30651 - DNA, 16 bp, Artificial Sequence
  synthetic [barcode part1]
tatcacgtaaccgacg

SEQ ID NO: 30652 - DNA, 16 bp, Artificial Sequence
  synthetic [barcode part1]
ttggaactaggtagac

SEQ ID NO: 30653 - DNA, 16 bp, Artificial Sequence
  synthetic [barcode part1]
gataaggtggcgaagt

SEQ ID NO: 30654 - DNA, 16 bp, Artificial Sequence
  synthetic [barcode part1]
gaactaagaccaggag

SEQ ID NO: 30655 - DNA, 16 bp, Artificial Sequence
  synthetic [barcode part1]
tctattcctcgtccag

SEQ ID NO: 30656 - DNA, 16 bp, Artificial Sequence
  synthetic [barcode part1]
aaggtggcgttattcc

SEQ ID NO: 30657 - DNA, 16 bp, Artificial Sequence
  synthetic [barcode part1]
tattgcgtaacgccag

SEQ ID NO: 30658 - DNA, 16 bp, Artificial Sequence
  synthetic [barcode part1]
ttcgtatcacggagac

SEQ ID NO: 30659 - DNA, 16 bp, Artificial Sequence
  synthetic [barcode part1]
tcacgaatcgcacaac

SEQ ID NO: 30660 - DNA, 16 bp, Artificial Sequence
  synthetic [barcode part1]
tggattagtgtgaggt

SEQ ID NO: 30661 - DNA, 16 bp, Artificial Sequence
  synthetic [barcode part1]
tcgaaggactaccttg

SEQ ID NO: 30662 - DNA, 16 bp, Artificial Sequence
  synthetic [barcode part1]
ccgttatactccacct

SEQ ID NO: 30663 - DNA, 16 bp, Artificial Sequence
  synthetic [barcode part1]
aggccactatcgaatc

SEQ ID NO: 30664 - DNA, 16 bp, Artificial Sequence
  synthetic [barcode part1]
acggttaccgactctc

SEQ ID NO: 30665 - DNA, 16 bp, Artificial Sequence
  synthetic [barcode part1]
ccttataccggtggtc

SEQ ID NO: 30666 - DNA, 16 bp, Artificial Sequence
  synthetic [barcode part1]
tactggaattcggcac

SEQ ID NO: 30667 - DNA, 16 bp, Artificial Sequence
  synthetic [barcode part1]
accgaatcaggaacgc

SEQ ID NO: 30668 - DNA, 16 bp, Artificial Sequence
  synthetic [barcode part1]
actgttgtcagtggtg

SEQ ID NO: 30669 - DNA, 16 bp, Artificial Sequence
  synthetic [barcode part1]
tatcaagaggtgcagt

SEQ ID NO: 30670 - DNA, 16 bp, Artificial Sequence
  synthetic [barcode part1]
acgtcctctaatagtc

SEQ ID NO: 30671 - DNA, 16 bp, Artificial Sequence
  synthetic [barcode part1]
tggttggaccaatcgt

SEQ ID NO: 30672 - DNA, 16 bp, Artificial Sequence
  synthetic [barcode part1]
cacctcaagtactcgc

SEQ ID NO: 30673 - DNA, 16 bp, Artificial Sequence
  synthetic [barcode part1]
ttcgttgccaatacgt

SEQ ID NO: 30674 - DNA, 16 bp, Artificial Sequence
  synthetic [barcode part1]
ttattcgacctcagac

SEQ ID NO: 30675 - DNA, 16 bp, Artificial Sequence
  synthetic [barcode part1]
gtaggcacctagagtg

SEQ ID NO: 30676 - DNA, 16 bp, Artificial Sequence
  synthetic [barcode part1]
agagagatccttcctg

SEQ ID NO: 30677 - DNA, 16 bp, Artificial Sequence
  synthetic [barcode part1]
ttactggtcctgcgtg

SEQ ID NO: 30678 - DNA, 16 bp, Artificial Sequence
  synthetic [barcode part1]
ccttaattcagtacgc

SEQ ID NO: 30679 - DNA, 16 bp, Artificial Sequence
  synthetic [barcode part1]
gaactgtaagtacgac

SEQ ID NO: 30680 - DNA, 16 bp, Artificial Sequence
  synthetic [barcode part1]
tggaaggaactctctc

SEQ ID NO: 30681 - DNA, 16 bp, Artificial Sequence
  synthetic [barcode part1]
ccgatattgtggtcag

SEQ ID NO: 30682 - DNA, 16 bp, Artificial Sequence
  synthetic [barcode part1]
aactcacctacaggtg

SEQ ID NO: 30683 - DNA, 16 bp, Artificial Sequence
  synthetic [barcode part1]
aacaagtgatactgcg

SEQ ID NO: 30684 - DNA, 16 bp, Artificial Sequence
  synthetic [barcode part1]
aggagtgtaggttgcc

SEQ ID NO: 30685 - DNA, 16 bp, Artificial Sequence
  synthetic [barcode part1]
tcctccaagtaacgag

SEQ ID NO: 30686 - DNA, 16 bp, Artificial Sequence
  synthetic [barcode part1]
agactactgtcaggtc

SEQ ID NO: 30687 - DNA, 16 bp, Artificial Sequence
  synthetic [barcode part1]
gtaggagtatagaggc

SEQ ID NO: 30688 - DNA, 16 bp, Artificial Sequence
  synthetic [barcode part1]
tcacctaatagtgcct

SEQ ID NO: 30689 - DNA, 16 bp, Artificial Sequence
  synthetic [barcode part1]
agagtctctacttgtc

SEQ ID NO: 30690 - DNA, 16 bp, Artificial Sequence
  synthetic [barcode part1]
tcctaccagtagaacg

SEQ ID NO: 30691 - DNA, 16 bp, Artificial Sequence
  synthetic [barcode part1]
gcgaattagaacggcc

SEQ ID NO: 30692 - DNA, 16 bp, Artificial Sequence
  synthetic [barcode part1]
ttgtgacactgcaacg

SEQ ID NO: 30693 - DNA, 16 bp, Artificial Sequence
  synthetic [barcode part1]
gaggactcagttgcag

SEQ ID NO: 30694 - DNA, 16 bp, Artificial Sequence
  synthetic [barcode part1]
ccgtcgaattaccaag

SEQ ID NO: 30695 - DNA, 16 bp, Artificial Sequence
  synthetic [barcode part1]
tagaattcctcgaggc

SEQ ID NO: 30696 - DNA, 16 bp, Artificial Sequence
  synthetic [barcode part1]
gagtggtcaacttctg

SEQ ID NO: 30697 - DNA, 16 bp, Artificial Sequence
  synthetic [barcode part1]
aacaaccttctacgtc

SEQ ID NO: 30698 - DNA, 16 bp, Artificial Sequence
  synthetic [barcode part1]
gcgtagtgagagacct

SEQ ID NO: 30699 - DNA, 16 bp, Artificial Sequence
  synthetic [barcode part1]
aagacggatcctactc

SEQ ID NO: 30700 - DNA, 16 bp, Artificial Sequence
  synthetic [barcode part1]
tggtctataggaacag

SEQ ID NO: 30701 - DNA, 16 bp, Artificial Sequence
  synthetic [barcode part1]
atacttcggtctaacc

SEQ ID NO: 30702 - DNA, 16 bp, Artificial Sequence
  synthetic [barcode part1]
taactgcaggtacctg

SEQ ID NO: 30703 - DNA, 16 bp, Artificial Sequence
  synthetic [barcode part1]
gacacgtacgttggtt

SEQ ID NO: 30704 - DNA, 16 bp, Artificial Sequence
  synthetic [barcode part1]
cgttgtacgtgtgtag

SEQ ID NO: 30705 - DNA, 16 bp, Artificial Sequence
  synthetic [barcode part1]
gagtgcacagtagtcg

SEQ ID NO: 30706 - DNA, 16 bp, Artificial Sequence
  synthetic [barcode part1]
caggtgacaagatccg

SEQ ID NO: 30707 - DNA, 16 bp, Artificial Sequence
  synthetic [barcode part1]
cgccttattacggacc

SEQ ID NO: 30708 - DNA, 16 bp, Artificial Sequence
  synthetic [barcode part1]
tatcgaccggttgtag

SEQ ID NO: 30709 - DNA, 16 bp, Artificial Sequence
  synthetic [barcode part1]
aatcctccacaagtct

SEQ ID NO: 30710 - DNA, 16 bp, Artificial Sequence
  synthetic [barcode part1]
aaccgacgagacttct

SEQ ID NO: 30711 - DNA, 16 bp, Artificial Sequence
  synthetic [barcode part1]
cggtaagatagatctg

SEQ ID NO: 30712 - DNA, 16 bp, Artificial Sequence
  synthetic [barcode part1]
ccacactctcaacgac

SEQ ID NO: 30713 - DNA, 16 bp, Artificial Sequence
  synthetic [barcode part1]
cactaccgtaaccacc

SEQ ID NO: 30714 - DNA, 16 bp, Artificial Sequence
  synthetic [barcode part1]
ccgtctaagactccac

SEQ ID NO: 30715 - DNA, 16 bp, Artificial Sequence
  synthetic [barcode part1]
ccggacttacgtcttg

SEQ ID NO: 30716 - DNA, 16 bp, Artificial Sequence
  synthetic [barcode part1]
taggcgataaggtccg

SEQ ID NO: 30717 - DNA, 16 bp, Artificial Sequence
  synthetic [barcode part1]
tacaccacctctcgag

SEQ ID NO: 30718 - DNA, 16 bp, Artificial Sequence
  synthetic [barcode part1]
cgaacgaattcactcg

SEQ ID NO: 30719 - DNA, 16 bp, Artificial Sequence
  synthetic [barcode part1]
aacgaggatatagtcc

SEQ ID NO: 30720 - DNA, 16 bp, Artificial Sequence
  synthetic [barcode part1]
ccggacgagtaggatt

SEQ ID NO: 30721 - DNA, 16 bp, Artificial Sequence
  synthetic [barcode part1]
cagactgcacacctct

SEQ ID NO: 30722 - DNA, 16 bp, Artificial Sequence
  synthetic [barcode part1]
tcctctctaaccggtt

SEQ ID NO: 30723 - DNA, 16 bp, Artificial Sequence
  synthetic [barcode part1]
tcaggcggtagtagac

SEQ ID NO: 30724 - DNA, 16 bp, Artificial Sequence
  synthetic [barcode part1]
gtaggtctagttcctt

SEQ ID NO: 30725 - DNA, 16 bp, Artificial Sequence
  synthetic [barcode part1]
ttcctatcagaccgcg

SEQ ID NO: 30726 - DNA, 16 bp, Artificial Sequence
  synthetic [barcode part1]
cgaggttatcggttgt

SEQ ID NO: 30727 - DNA, 16 bp, Artificial Sequence
  synthetic [barcode part1]
ttgcctacactcgtct

SEQ ID NO: 30728 - DNA, 16 bp, Artificial Sequence
  synthetic [barcode part1]
tcgtgattacacgcag

SEQ ID NO: 30729 - DNA, 16 bp, Artificial Sequence
  synthetic [barcode part1]
aggatccgtctgtcct

SEQ ID NO: 30730 - DNA, 16 bp, Artificial Sequence
  synthetic [barcode part1]
cctggtggataattcg

SEQ ID NO: 30731 - DNA, 16 bp, Artificial Sequence
  synthetic [barcode part1]
gccttatcggaaggtt

SEQ ID NO: 30732 - DNA, 16 bp, Artificial Sequence
  synthetic [barcode part1]
taggtacacacgatcc

SEQ ID NO: 30733 - DNA, 16 bp, Artificial Sequence
  synthetic [barcode part1]
ttactgtctgtggatc

SEQ ID NO: 30734 - DNA, 16 bp, Artificial Sequence
  synthetic [barcode part1]
gttcggacgttgtcct

SEQ ID NO: 30735 - DNA, 16 bp, Artificial Sequence
  synthetic [barcode part1]
tctaatcgttacgcac

SEQ ID NO: 30736 - DNA, 16 bp, Artificial Sequence
  synthetic [barcode part1]
tagtcagtacgacacc

SEQ ID NO: 30737 - DNA, 16 bp, Artificial Sequence
  synthetic [barcode part1]
tcttggcctctattgc

SEQ ID NO: 30738 - DNA, 16 bp, Artificial Sequence
  synthetic [barcode part1]
tgttggagtagaggcc

SEQ ID NO: 30739 - DNA, 16 bp, Artificial Sequence
  synthetic [barcode part1]
gcaaccaaccaacgtt

SEQ ID NO: 30740 - DNA, 16 bp, Artificial Sequence
  synthetic [barcode part1]
tggtactccacagtag

SEQ ID NO: 30741 - DNA, 16 bp, Artificial Sequence
  synthetic [barcode part1]
accagttaggagagag

SEQ ID NO: 30742 - DNA, 16 bp, Artificial Sequence
  synthetic [barcode part1]
ttggtggtctgacagt

SEQ ID NO: 30743 - DNA, 16 bp, Artificial Sequence
  synthetic [barcode part1]
tggacgtcgtattggt

SEQ ID NO: 30744 - DNA, 16 bp, Artificial Sequence
  synthetic [barcode part1]
ttctccggaacgttcg

SEQ ID NO: 30745 - DNA, 16 bp, Artificial Sequence
  synthetic [barcode part1]
agtgattccgagtcgt

SEQ ID NO: 30746 - DNA, 16 bp, Artificial Sequence
  synthetic [barcode part1]
aggagtgttgttagac

SEQ ID NO: 30747 - DNA, 16 bp, Artificial Sequence
  synthetic [barcode part1]
gtagttgttaacctcc

SEQ ID NO: 30748 - DNA, 16 bp, Artificial Sequence
  synthetic [barcode part1]
gtagtcgacgccaatt

SEQ ID NO: 30749 - DNA, 16 bp, Artificial Sequence
  synthetic [barcode part1]
gtgagttgttaccttc

SEQ ID NO: 30750 - DNA, 16 bp, Artificial Sequence
  synthetic [barcode part1]
ccagtgcgagattgag

SEQ ID NO: 30751 - DNA, 16 bp, Artificial Sequence
  synthetic [barcode part1]
agtgtaacggaccgtg

SEQ ID NO: 30752 - DNA, 16 bp, Artificial Sequence
  synthetic [barcode part1]
agttcgttcgtgaacg

SEQ ID NO: 30753 - DNA, 16 bp, Artificial Sequence
  synthetic [barcode part1]
gcgtagtagagttagt

SEQ ID NO: 30754 - DNA, 16 bp, Artificial Sequence
  synthetic [barcode part1]
tcctccagtaattacg

SEQ ID NO: 30755 - DNA, 16 bp, Artificial Sequence
  synthetic [barcode part1]
cgtgtaaggcagtgac

SEQ ID NO: 30756 - DNA, 16 bp, Artificial Sequence
  synthetic [barcode part1]
ataccaccaagtagag

SEQ ID NO: 30757 - DNA, 16 bp, Artificial Sequence
  synthetic [barcode part1]
caaggaggtgtcaacc

SEQ ID NO: 30758 - DNA, 16 bp, Artificial Sequence
  synthetic [barcode part1]
gtacaggaagtgcaag

SEQ ID NO: 30759 - DNA, 16 bp, Artificial Sequence
  synthetic [barcode part1]
gagtacgtcaggtcag

SEQ ID NO: 30760 - DNA, 16 bp, Artificial Sequence
  synthetic [barcode part1]
acggtagttcacggag

SEQ ID NO: 30761 - DNA, 16 bp, Artificial Sequence
  synthetic [barcode part1]
gacaaccttggcagtt

SEQ ID NO: 30762 - DNA, 16 bp, Artificial Sequence
  synthetic [barcode part1]
gataccaatcggttgc

SEQ ID NO: 30763 - DNA, 16 bp, Artificial Sequence
  synthetic [barcode part1]
atacggccagtacact

SEQ ID NO: 30764 - DNA, 16 bp, Artificial Sequence
  synthetic [barcode part1]
caatcgacaacgttgc

SEQ ID NO: 30765 - DNA, 16 bp, Artificial Sequence
  synthetic [barcode part1]
aacgcgagttcttgtg

SEQ ID NO: 30766 - DNA, 16 bp, Artificial Sequence
  synthetic [barcode part1]
gtgtagttgtaaccgc

SEQ ID NO: 30767 - DNA, 16 bp, Artificial Sequence
  synthetic [barcode part1]
actcttgaagtcacct

SEQ ID NO: 30768 - DNA, 16 bp, Artificial Sequence
  synthetic [barcode part1]
ttgcgaggcgactatt

SEQ ID NO: 30769 - DNA, 16 bp, Artificial Sequence
  synthetic [barcode part1]
tgcagaggtatctctg

SEQ ID NO: 30770 - DNA, 16 bp, Artificial Sequence
  synthetic [barcode part1]
ttcgaccagttggaac

SEQ ID NO: 30771 - DNA, 16 bp, Artificial Sequence
  synthetic [barcode part1]
gttaattggccaaccg

SEQ ID NO: 30772 - DNA, 16 bp, Artificial Sequence
  synthetic [barcode part1]
aatccgtgaacttgcg

SEQ ID NO: 30773 - DNA, 16 bp, Artificial Sequence
  synthetic [barcode part1]
tgccagagacacgagt

SEQ ID NO: 30774 - DNA, 16 bp, Artificial Sequence
  synthetic [barcode part1]
gacaagagtcacctct

SEQ ID NO: 30775 - DNA, 16 bp, Artificial Sequence
  synthetic [barcode part1]
caatcgaacactgtgc

SEQ ID NO: 30776 - DNA, 16 bp, Artificial Sequence
  synthetic [barcode part1]
gaggtaacgagtatct

SEQ ID NO: 30777 - DNA, 16 bp, Artificial Sequence
  synthetic [barcode part1]
gcggataacctcagag

SEQ ID NO: 30778 - DNA, 16 bp, Artificial Sequence
  synthetic [barcode part1]
caggaaccttacgttg

SEQ ID NO: 30779 - DNA, 16 bp, Artificial Sequence
  synthetic [barcode part1]
agtatccacaagacag

SEQ ID NO: 30780 - DNA, 16 bp, Artificial Sequence
  synthetic [barcode part1]
tatccaggtgcctaag

SEQ ID NO: 30781 - DNA, 16 bp, Artificial Sequence
  synthetic [barcode part1]
tacgtgacaagaggcc

SEQ ID NO: 30782 - DNA, 16 bp, Artificial Sequence
  synthetic [barcode part1]
taggccggttgaattc

SEQ ID NO: 30783 - DNA, 16 bp, Artificial Sequence
  synthetic [barcode part1]
cgtagacttaccttgt

SEQ ID NO: 30784 - DNA, 16 bp, Artificial Sequence
  synthetic [barcode part1]
tccaccgtgatcttct

SEQ ID NO: 30785 - DNA, 16 bp, Artificial Sequence
  synthetic [barcode part1]
gaaggatctatcgcct

SEQ ID NO: 30786 - DNA, 16 bp, Artificial Sequence
  synthetic [barcode part1]
aggaggcctgttatct

SEQ ID NO: 30787 - DNA, 16 bp, Artificial Sequence
  synthetic [barcode part1]
actcgttgtctcaagt

SEQ ID NO: 30788 - DNA, 16 bp, Artificial Sequence
  synthetic [barcode part1]
acttccaggacgtagt

SEQ ID NO: 30789 - DNA, 16 bp, Artificial Sequence
  synthetic [barcode part1]
tcgttgacttcgtgcg

SEQ ID NO: 30790 - DNA, 16 bp, Artificial Sequence
  synthetic [barcode part1]
cagttccaatccttcc

SEQ ID NO: 30791 - DNA, 16 bp, Artificial Sequence
  synthetic [barcode part1]
agaacctgttccagac

SEQ ID NO: 30792 - DNA, 16 bp, Artificial Sequence
  synthetic [barcode part1]
ccactgcgtagtaagt

SEQ ID NO: 30793 - DNA, 16 bp, Artificial Sequence
  synthetic [barcode part1]
cgttgtcgttctctac

SEQ ID NO: 30794 - DNA, 16 bp, Artificial Sequence
  synthetic [barcode part1]
agttgtgacacgtcac

SEQ ID NO: 30795 - DNA, 16 bp, Artificial Sequence
  synthetic [barcode part1]
tgtctgccttaggacc

SEQ ID NO: 30796 - DNA, 16 bp, Artificial Sequence
  synthetic [barcode part1]
atccaggaagtaacgt

SEQ ID NO: 30797 - DNA, 16 bp, Artificial Sequence
  synthetic [barcode part1]
cgaatcaaggacacgc

SEQ ID NO: 30798 - DNA, 16 bp, Artificial Sequence
  synthetic [barcode part1]
ccagtctatccgaacc

SEQ ID NO: 30799 - DNA, 16 bp, Artificial Sequence
  synthetic [barcode part1]
cgatctactatacctg

SEQ ID NO: 30800 - DNA, 16 bp, Artificial Sequence
  synthetic [barcode part1]
tggtcgacgatatcgt

SEQ ID NO: 30801 - DNA, 16 bp, Artificial Sequence
  synthetic [barcode part1]
accgaaggattaggag

SEQ ID NO: 30802 - DNA, 16 bp, Artificial Sequence
  synthetic [barcode part1]
cgttactcctgtaagt

SEQ ID NO: 30803 - DNA, 16 bp, Artificial Sequence
  synthetic [barcode part1]
gtaactgtacggttgc

SEQ ID NO: 30804 - DNA, 16 bp, Artificial Sequence
  synthetic [barcode part1]
cgaaggttccgtattg

SEQ ID NO: 30805 - DNA, 16 bp, Artificial Sequence
  synthetic [barcode part1]
tggaactaatcggtcc

SEQ ID NO: 30806 - DNA, 16 bp, Artificial Sequence
  synthetic [barcode part1]
agatcggtctcgattg

SEQ ID NO: 30807 - DNA, 16 bp, Artificial Sequence
  synthetic [barcode part1]
tactctagacaaggcc

SEQ ID NO: 30808 - DNA, 16 bp, Artificial Sequence
  synthetic [barcode part1]
gacctccttaagtgtt

SEQ ID NO: 30809 - DNA, 16 bp, Artificial Sequence
  synthetic [barcode part1]
ttatccaacaacgtcc

SEQ ID NO: 30810 - DNA, 16 bp, Artificial Sequence
  synthetic [barcode part1]
attggaccttgtatcc

SEQ ID NO: 30811 - DNA, 16 bp, Artificial Sequence
  synthetic [barcode part1]
attaggacttcggtcg

SEQ ID NO: 30812 - DNA, 16 bp, Artificial Sequence
  synthetic [barcode part1]
actcaggcctaccact

SEQ ID NO: 30813 - DNA, 16 bp, Artificial Sequence
  synthetic [barcode part1]
ccttgcgtaacaactt

SEQ ID NO: 30814 - DNA, 16 bp, Artificial Sequence
  synthetic [barcode part1]
gttacaagtctgtcct

SEQ ID NO: 30815 - DNA, 16 bp, Artificial Sequence
  synthetic [barcode part1]
tctccgagtataccgc

SEQ ID NO: 30816 - DNA, 16 bp, Artificial Sequence
  synthetic [barcode part1]
aattatccgtctccag

SEQ ID NO: 30817 - DNA, 16 bp, Artificial Sequence
  synthetic [barcode part1]
aattgagtccgactcg

SEQ ID NO: 30818 - DNA, 16 bp, Artificial Sequence
  synthetic [barcode part1]
aagacttccgtgacgt

SEQ ID NO: 30819 - DNA, 16 bp, Artificial Sequence
  synthetic [barcode part1]
tcaggttactgccaag

SEQ ID NO: 30820 - DNA, 16 bp, Artificial Sequence
  synthetic [barcode part1]
cgaagttctctcttcc

SEQ ID NO: 30821 - DNA, 16 bp, Artificial Sequence
  synthetic [barcode part1]
caatagtccttgcgtt

SEQ ID NO: 30822 - DNA, 16 bp, Artificial Sequence
  synthetic [barcode part1]
acaagtcaagaaccac

SEQ ID NO: 30823 - DNA, 16 bp, Artificial Sequence
  synthetic [barcode part1]
gagagtgtaggtcacc

SEQ ID NO: 30824 - DNA, 16 bp, Artificial Sequence
  synthetic [barcode part1]
cagacagagtgagtag

SEQ ID NO: 30825 - DNA, 16 bp, Artificial Sequence
  synthetic [barcode part1]
aacaatcctcttgcgt

SEQ ID NO: 30826 - DNA, 16 bp, Artificial Sequence
  synthetic [barcode part1]
gaccgtacctcttggt

SEQ ID NO: 30827 - DNA, 16 bp, Artificial Sequence
  synthetic [barcode part1]
ttgttggtgacctgag

SEQ ID NO: 30828 - DNA, 16 bp, Artificial Sequence
  synthetic [barcode part1]
cagaatcgcgttacac

SEQ ID NO: 30829 - DNA, 16 bp, Artificial Sequence
  synthetic [barcode part1]
cgttctacgaagtggt

SEQ ID NO: 30830 - DNA, 16 bp, Artificial Sequence
  synthetic [barcode part1]
aactcgtggcaaggtg

SEQ ID NO: 30831 - DNA, 16 bp, Artificial Sequence
  synthetic [barcode part1]
aacttctctcctggtc

SEQ ID NO: 30832 - DNA, 16 bp, Artificial Sequence
  synthetic [barcode part1]
gtacttgcgttgtccg

SEQ ID NO: 30833 - DNA, 16 bp, Artificial Sequence
  synthetic [barcode part1]
gaaggcaatccgacac

SEQ ID NO: 30834 - DNA, 16 bp, Artificial Sequence
  synthetic [barcode part1]
gatcggttaacgtcgt

SEQ ID NO: 30835 - DNA, 16 bp, Artificial Sequence
  synthetic [barcode part1]
attggtatccgacctt

SEQ ID NO: 30836 - DNA, 16 bp, Artificial Sequence
  synthetic [barcode part1]
tctcgtctatctgaag

SEQ ID NO: 30837 - DNA, 16 bp, Artificial Sequence
  synthetic [barcode part1]
tctaataacttccgcg

SEQ ID NO: 30838 - DNA, 16 bp, Artificial Sequence
  synthetic [barcode part1]
tcacaagtgaggaatc

SEQ ID NO: 30839 - DNA, 16 bp, Artificial Sequence
  synthetic [barcode part1]
tctgtatcggtggtcc

SEQ ID NO: 30840 - DNA, 16 bp, Artificial Sequence
  synthetic [barcode part1]
ccaccgagttagattg

SEQ ID NO: 30841 - DNA, 16 bp, Artificial Sequence
  synthetic [barcode part1]
aatccgaactatcggc

SEQ ID NO: 30842 - DNA, 16 bp, Artificial Sequence
  synthetic [barcode part1]
caccgaacttagtggt

SEQ ID NO: 30843 - DNA, 16 bp, Artificial Sequence
  synthetic [barcode part1]
cgaagaagtacgttgt

SEQ ID NO: 30844 - DNA, 16 bp, Artificial Sequence
  synthetic [barcode part1]
actatcggactaccag

SEQ ID NO: 30845 - DNA, 16 bp, Artificial Sequence
  synthetic [barcode part1]
gtaacggactcgaacg

SEQ ID NO: 30846 - DNA, 16 bp, Artificial Sequence
  synthetic [barcode part1]
aacagaggcacaatct

SEQ ID NO: 30847 - DNA, 16 bp, Artificial Sequence
  synthetic [barcode part1]
ttgtgtccttgtgcct

SEQ ID NO: 30848 - DNA, 16 bp, Artificial Sequence
  synthetic [barcode part1]
gaacgtctcgccttgt

SEQ ID NO: 30849 - DNA, 16 bp, Artificial Sequence
  synthetic [barcode part1]
tcgtacctaccaggtc

SEQ ID NO: 30850 - DNA, 16 bp, Artificial Sequence
  synthetic [barcode part1]
accttgaaccgtaacg

SEQ ID NO: 30851 - DNA, 16 bp, Artificial Sequence
  synthetic [barcode part1]
aactcactcacagacg

SEQ ID NO: 30852 - DNA, 16 bp, Artificial Sequence
  synthetic [barcode part1]
gccgttgaagatatag

SEQ ID NO: 30853 - DNA, 16 bp, Artificial Sequence
  synthetic [barcode part1]
cgaccgtacgaagtag

SEQ ID NO: 30854 - DNA, 16 bp, Artificial Sequence
  synthetic [barcode part1]
ataactaccgactctc

SEQ ID NO: 30855 - DNA, 16 bp, Artificial Sequence
  synthetic [barcode part1]
gtctctctctcaatcg

SEQ ID NO: 30856 - DNA, 16 bp, Artificial Sequence
  synthetic [barcode part1]
cctaccaatcgttctc

SEQ ID NO: 30857 - DNA, 16 bp, Artificial Sequence
  synthetic [barcode part1]
tcggtgcaactccttg

SEQ ID NO: 30858 - DNA, 16 bp, Artificial Sequence
  synthetic [barcode part1]
acagatcgaggcgatc

SEQ ID NO: 30859 - DNA, 16 bp, Artificial Sequence
  synthetic [barcode part1]
ccttccaagatatctg

SEQ ID NO: 30860 - DNA, 16 bp, Artificial Sequence
  synthetic [barcode part1]
gacgcaaggtagtctg

SEQ ID NO: 30861 - DNA, 16 bp, Artificial Sequence
  synthetic [barcode part1]
gtggattgtgcagttc

SEQ ID NO: 30862 - DNA, 16 bp, Artificial Sequence
  synthetic [barcode part1]
aacagtcctccacgtc

SEQ ID NO: 30863 - DNA, 16 bp, Artificial Sequence
  synthetic [barcode part1]
ttggttgtcagagtcg

SEQ ID NO: 30864 - DNA, 16 bp, Artificial Sequence
  synthetic [barcode part1]
ttccgtacctctgtgt

SEQ ID NO: 30865 - DNA, 16 bp, Artificial Sequence
  synthetic [barcode part1]
tacagaacgatccaag

SEQ ID NO: 30866 - DNA, 16 bp, Artificial Sequence
  synthetic [barcode part1]
cggatatcacaagtcc

SEQ ID NO: 30867 - DNA, 16 bp, Artificial Sequence
  synthetic [barcode part1]
ccaagtgtgttactct

SEQ ID NO: 30868 - DNA, 16 bp, Artificial Sequence
  synthetic [barcode part1]
agacgttgatagagtc

SEQ ID NO: 30869 - DNA, 16 bp, Artificial Sequence
  synthetic [barcode part1]
tgagtgcaaggcaatt

SEQ ID NO: 30870 - DNA, 16 bp, Artificial Sequence
  synthetic [barcode part1]
agaaccgactacttcg

SEQ ID NO: 30871 - DNA, 16 bp, Artificial Sequence
  synthetic [barcode part1]
cgcgtctggcaatctt

SEQ ID NO: 30872 - DNA, 16 bp, Artificial Sequence
  synthetic [barcode part1]
caatcttccggaagac

SEQ ID NO: 30873 - DNA, 16 bp, Artificial Sequence
  synthetic [barcode part1]
tgtacaggcctctcac

SEQ ID NO: 30874 - DNA, 16 bp, Artificial Sequence
  synthetic [barcode part1]
gactgtggatcggagt

SEQ ID NO: 30875 - DNA, 16 bp, Artificial Sequence
  synthetic [barcode part1]
tatccttcgcagagag

SEQ ID NO: 30876 - DNA, 16 bp, Artificial Sequence
  synthetic [barcode part1]
taatcgcggcgtattg

SEQ ID NO: 30877 - DNA, 16 bp, Artificial Sequence
  synthetic [barcode part1]
tcttcagaccaacact

SEQ ID NO: 30878 - DNA, 16 bp, Artificial Sequence
  synthetic [barcode part1]
aattacgagtcctcct

SEQ ID NO: 30879 - DNA, 16 bp, Artificial Sequence
  synthetic [barcode part1]
taacaccgtgaacaag

SEQ ID NO: 30880 - DNA, 16 bp, Artificial Sequence
  synthetic [barcode part1]
tgcctactgaataggc

SEQ ID NO: 30881 - DNA, 16 bp, Artificial Sequence
  synthetic [barcode part1]
cgcaataagacggacc

SEQ ID NO: 30882 - DNA, 16 bp, Artificial Sequence
  synthetic [barcode part1]
caacggagatatctag

SEQ ID NO: 30883 - DNA, 16 bp, Artificial Sequence
  synthetic [barcode part1]
atccagagtgagttcc

SEQ ID NO: 30884 - DNA, 16 bp, Artificial Sequence
  synthetic [barcode part1]
cctaagttcgtcaccg

SEQ ID NO: 30885 - DNA, 16 bp, Artificial Sequence
  synthetic [barcode part1]
cactagtgcactaacg

SEQ ID NO: 30886 - DNA, 16 bp, Artificial Sequence
  synthetic [barcode part1]
ttctgtggtacctcct

SEQ ID NO: 30887 - DNA, 16 bp, Artificial Sequence
  synthetic [barcode part1]
tccagtctcttgatcc

SEQ ID NO: 30888 - DNA, 16 bp, Artificial Sequence
  synthetic [barcode part1]
gacttctggagactgt

SEQ ID NO: 30889 - DNA, 16 bp, Artificial Sequence
  synthetic [barcode part1]
cggttcgacaagagtg

SEQ ID NO: 30890 - DNA, 16 bp, Artificial Sequence
  synthetic [barcode part1]
taggacgtaccttacg

SEQ ID NO: 30891 - DNA, 16 bp, Artificial Sequence
  synthetic [barcode part1]
accagtacggattcac

SEQ ID NO: 30892 - DNA, 16 bp, Artificial Sequence
  synthetic [barcode part1]
ccactcgttcagaatt

SEQ ID NO: 30893 - DNA, 16 bp, Artificial Sequence
  synthetic [barcode part1]
cagtactcgaatagag

SEQ ID NO: 30894 - DNA, 16 bp, Artificial Sequence
  synthetic [barcode part1]
aacttaaccggcgatc

SEQ ID NO: 30895 - DNA, 16 bp, Artificial Sequence
  synthetic [barcode part1]
gattacgcacacaacc

SEQ ID NO: 30896 - DNA, 16 bp, Artificial Sequence
  synthetic [barcode part1]
gcggttgatataccac

SEQ ID NO: 30897 - DNA, 16 bp, Artificial Sequence
  synthetic [barcode part1]
caatccttaaccacgt

SEQ ID NO: 30898 - DNA, 16 bp, Artificial Sequence
  synthetic [barcode part1]
gtcaacttcctggaag

SEQ ID NO: 30899 - DNA, 16 bp, Artificial Sequence
  synthetic [barcode part1]
tatacggacggttacc

SEQ ID NO: 30900 - DNA, 16 bp, Artificial Sequence
  synthetic [barcode part1]
aagtccggagtcgagt

SEQ ID NO: 30901 - DNA, 16 bp, Artificial Sequence
  synthetic [barcode part1]
accggtgaacaataac

SEQ ID NO: 30902 - DNA, 16 bp, Artificial Sequence
  synthetic [barcode part1]
attacctggtgaggtc

SEQ ID NO: 30903 - DNA, 16 bp, Artificial Sequence
  synthetic [barcode part1]
agtaccgataccacgt

SEQ ID NO: 30904 - DNA, 16 bp, Artificial Sequence
  synthetic [barcode part1]
aattgagtgagtccag

SEQ ID NO: 30905 - DNA, 16 bp, Artificial Sequence
  synthetic [barcode part1]
cggtgtagttaagagt

SEQ ID NO: 30906 - DNA, 16 bp, Artificial Sequence
  synthetic [barcode part1]
gttgttcctcaagtgt

SEQ ID NO: 30907 - DNA, 16 bp, Artificial Sequence
  synthetic [barcode part1]
actcgttcttgcctgt

SEQ ID NO: 30908 - DNA, 16 bp, Artificial Sequence
  synthetic [barcode part1]
caacgatcacagaggc

SEQ ID NO: 30909 - DNA, 16 bp, Artificial Sequence
  synthetic [barcode part1]
cacaagtaagtagtgc

SEQ ID NO: 30910 - DNA, 16 bp, Artificial Sequence
  synthetic [barcode part1]
gatcgactccttcctt

SEQ ID NO: 30911 - DNA, 16 bp, Artificial Sequence
  synthetic [barcode part1]
gcaccttatcaggtcc

SEQ ID NO: 30912 - DNA, 16 bp, Artificial Sequence
  synthetic [barcode part1]
gttgttgttctacgtg

SEQ ID NO: 30913 - DNA, 16 bp, Artificial Sequence
  synthetic [barcode part1]
acgtaacgtatcgacc

SEQ ID NO: 30914 - DNA, 16 bp, Artificial Sequence
  synthetic [barcode part1]
gtaggacggacaatag

SEQ ID NO: 30915 - DNA, 16 bp, Artificial Sequence
  synthetic [barcode part1]
tcctggcaatctgcgt

SEQ ID NO: 30916 - DNA, 16 bp, Artificial Sequence
  synthetic [barcode part1]
atctgttgtgacactc

SEQ ID NO: 30917 - DNA, 16 bp, Artificial Sequence
  synthetic [barcode part1]
ttgtgtgacactggtg

SEQ ID NO: 30918 - DNA, 16 bp, Artificial Sequence
  synthetic [barcode part1]
gccactctattgcctt

SEQ ID NO: 30919 - DNA, 16 bp, Artificial Sequence
  synthetic [barcode part1]
acgacgacaccaacag

SEQ ID NO: 30920 - DNA, 16 bp, Artificial Sequence
  synthetic [barcode part1]
ttgtaggtccgactcc

SEQ ID NO: 30921 - DNA, 16 bp, Artificial Sequence
  synthetic [barcode part1]
tacttcgttgcgagtt

SEQ ID NO: 30922 - DNA, 16 bp, Artificial Sequence
  synthetic [barcode part1]
aggcgtaagtccaacg

SEQ ID NO: 30923 - DNA, 16 bp, Artificial Sequence
  synthetic [barcode part1]
cggtgataactcggtt

SEQ ID NO: 30924 - DNA, 16 bp, Artificial Sequence
  synthetic [barcode part1]
cgtacttattcggtgt

SEQ ID NO: 30925 - DNA, 16 bp, Artificial Sequence
  synthetic [barcode part1]
tactgacggccagaag

SEQ ID NO: 30926 - DNA, 16 bp, Artificial Sequence
  synthetic [barcode part1]
aagattgcggttcctg

SEQ ID NO: 30927 - DNA, 16 bp, Artificial Sequence
  synthetic [barcode part1]
cggacaacactgcaag

SEQ ID NO: 30928 - DNA, 16 bp, Artificial Sequence
  synthetic [barcode part1]
caacttggttctcgcg

SEQ ID NO: 30929 - DNA, 16 bp, Artificial Sequence
  synthetic [barcode part1]
actcgtcttacagtac

SEQ ID NO: 30930 - DNA, 16 bp, Artificial Sequence
  synthetic [barcode part1]
ttgtaggaacggtaac

SEQ ID NO: 30931 - DNA, 16 bp, Artificial Sequence
  synthetic [barcode part1]
ttacgtcgacaactct

SEQ ID NO: 30932 - DNA, 16 bp, Artificial Sequence
  synthetic [barcode part1]
gacttgaggtctagtc

SEQ ID NO: 30933 - DNA, 16 bp, Artificial Sequence
  synthetic [barcode part1]
tgaatcgaagaacgtc

SEQ ID NO: 30934 - DNA, 16 bp, Artificial Sequence
  synthetic [barcode part1]
ccttcagacaccagtc

SEQ ID NO: 30935 - DNA, 16 bp, Artificial Sequence
  synthetic [barcode part1]
tcaggtggcgaattct

SEQ ID NO: 30936 - DNA, 16 bp, Artificial Sequence
  synthetic [barcode part1]
acacaacgttgacacc

SEQ ID NO: 30937 - DNA, 16 bp, Artificial Sequence
  synthetic [barcode part1]
tcacagacctggtctc

SEQ ID NO: 30938 - DNA, 16 bp, Artificial Sequence
  synthetic [barcode part1]
agaggcagtctgacac

SEQ ID NO: 30939 - DNA, 16 bp, Artificial Sequence
  synthetic [barcode part1]
accttgtgagtactct

SEQ ID NO: 30940 - DNA, 16 bp, Artificial Sequence
  synthetic [barcode part1]
cgatatcgtgacactg

SEQ ID NO: 30941 - DNA, 16 bp, Artificial Sequence
  synthetic [barcode part1]
gcgatcaatcacacgt

SEQ ID NO: 30942 - DNA, 16 bp, Artificial Sequence
  synthetic [barcode part1]
ttgcagtagtctcgag

SEQ ID NO: 30943 - DNA, 16 bp, Artificial Sequence
  synthetic [barcode part1]
tggccttctctagttc

SEQ ID NO: 30944 - DNA, 16 bp, Artificial Sequence
  synthetic [barcode part1]
atacgcgacgtgtact

SEQ ID NO: 30945 - DNA, 16 bp, Artificial Sequence
  synthetic [barcode part1]
tgcaatcacgcagttg

SEQ ID NO: 30946 - DNA, 16 bp, Artificial Sequence
  synthetic [barcode part1]
tcagagtgcaacgttc

SEQ ID NO: 30947 - DNA, 16 bp, Artificial Sequence
  synthetic [barcode part1]
tactgttccgttgtcc

SEQ ID NO: 30948 - DNA, 16 bp, Artificial Sequence
  synthetic [barcode part1]
tgttgacgttgacacg

SEQ ID NO: 30949 - DNA, 16 bp, Artificial Sequence
  synthetic [barcode part1]
aataatcgcacctctc

SEQ ID NO: 30950 - DNA, 16 bp, Artificial Sequence
  synthetic [barcode part1]
taggacctcggaactt

SEQ ID NO: 30951 - DNA, 16 bp, Artificial Sequence
  synthetic [barcode part1]
ccggcaattgttgaac

SEQ ID NO: 30952 - DNA, 16 bp, Artificial Sequence
  synthetic [barcode part1]
gatcaggactcgagtg

SEQ ID NO: 30953 - DNA, 16 bp, Artificial Sequence
  synthetic [barcode part1]
gagtgtcctacgaact

SEQ ID NO: 30954 - DNA, 16 bp, Artificial Sequence
  synthetic [barcode part1]
gcacaagttacgttcg

SEQ ID NO: 30955 - DNA, 16 bp, Artificial Sequence
  synthetic [barcode part1]
attaggagtatcggtg

SEQ ID NO: 30956 - DNA, 16 bp, Artificial Sequence
  synthetic [barcode part1]
gcgcacgcaatcaatt

SEQ ID NO: 30957 - DNA, 16 bp, Artificial Sequence
  synthetic [barcode part1]
tagtccactgtattcg

SEQ ID NO: 30958 - DNA, 16 bp, Artificial Sequence
  synthetic [barcode part1]
ttatcacggtgtccgc

SEQ ID NO: 30959 - DNA, 16 bp, Artificial Sequence
  synthetic [barcode part1]
agtacgcctctctggt

SEQ ID NO: 30960 - DNA, 16 bp, Artificial Sequence
  synthetic [barcode part1]
cgtctgttaagattcc

SEQ ID NO: 30961 - DNA, 16 bp, Artificial Sequence
  synthetic [barcode part1]
ttctcaggttgtgtgt

SEQ ID NO: 30962 - DNA, 16 bp, Artificial Sequence
  synthetic [barcode part1]
actcgtcttgtgatac

SEQ ID NO: 30963 - DNA, 16 bp, Artificial Sequence
  synthetic [barcode part1]
tattcactcacaacgc

SEQ ID NO: 30964 - DNA, 16 bp, Artificial Sequence
  synthetic [barcode part1]
gttattctaggcgttc

SEQ ID NO: 30965 - DNA, 16 bp, Artificial Sequence
  synthetic [barcode part1]
cgtgcacactaactag

SEQ ID NO: 30966 - DNA, 16 bp, Artificial Sequence
  synthetic [barcode part1]
cctctactagaccgtg

SEQ ID NO: 30967 - DNA, 16 bp, Artificial Sequence
  synthetic [barcode part1]
gaactcacgagagacc

SEQ ID NO: 30968 - DNA, 16 bp, Artificial Sequence
  synthetic [barcode part1]
gacgcgtggaattgac

SEQ ID NO: 30969 - DNA, 16 bp, Artificial Sequence
  synthetic [barcode part1]
tctatcaagttgcacc

SEQ ID NO: 30970 - DNA, 16 bp, Artificial Sequence
  synthetic [barcode part1]
tggaactccgagattc

SEQ ID NO: 30971 - DNA, 16 bp, Artificial Sequence
  synthetic [barcode part1]
gtaccaacctcactgc

SEQ ID NO: 30972 - DNA, 16 bp, Artificial Sequence
  synthetic [barcode part1]
tccgttgtgtgagtcc

SEQ ID NO: 30973 - DNA, 16 bp, Artificial Sequence
  synthetic [barcode part1]
gtcttccggaagattg

SEQ ID NO: 30974 - DNA, 16 bp, Artificial Sequence
  synthetic [barcode part1]
gttgacacaagttcgc

SEQ ID NO: 30975 - DNA, 16 bp, Artificial Sequence
  synthetic [barcode part1]
gcagtcgtcaatcctc

SEQ ID NO: 30976 - DNA, 16 bp, Artificial Sequence
  synthetic [barcode part1]
tgacctaagtacgaag

SEQ ID NO: 30977 - DNA, 16 bp, Artificial Sequence
  synthetic [barcode part1]
tccggccagaattaac

SEQ ID NO: 30978 - DNA, 16 bp, Artificial Sequence
  synthetic [barcode part1]
atcttcaacgactcac

SEQ ID NO: 30979 - DNA, 16 bp, Artificial Sequence
  synthetic [barcode part1]
cagagagatacgtcgc

SEQ ID NO: 30980 - DNA, 16 bp, Artificial Sequence
  synthetic [barcode part1]
accacggttattcgcc

SEQ ID NO: 30981 - DNA, 16 bp, Artificial Sequence
  synthetic [barcode part1]
caataccgatatcgcg

SEQ ID NO: 30982 - DNA, 16 bp, Artificial Sequence
  synthetic [barcode part1]
tcgtgtagacctcctg

SEQ ID NO: 30983 - DNA, 16 bp, Artificial Sequence
  synthetic [barcode part1]
gactcctaatctgcgc

SEQ ID NO: 30984 - DNA, 16 bp, Artificial Sequence
  synthetic [barcode part1]
ttagtgagtcctcact

SEQ ID NO: 30985 - DNA, 16 bp, Artificial Sequence
  synthetic [barcode part1]
tactgactggtacgtg

SEQ ID NO: 30986 - DNA, 16 bp, Artificial Sequence
  synthetic [barcode part1]
gtcacaacgagacttc

SEQ ID NO: 30987 - DNA, 16 bp, Artificial Sequence
  synthetic [barcode part1]
gcgaccgttccaatct

SEQ ID NO: 30988 - DNA, 16 bp, Artificial Sequence
  synthetic [barcode part1]
ataggcgtacttaccg

SEQ ID NO: 30989 - DNA, 16 bp, Artificial Sequence
  synthetic [barcode part1]
tgatctcgaccaaggt

SEQ ID NO: 30990 - DNA, 16 bp, Artificial Sequence
  synthetic [barcode part1]
tgagtaagtggtgttg

SEQ ID NO: 30991 - DNA, 16 bp, Artificial Sequence
  synthetic [barcode part1]
tactaggtccgcactc

SEQ ID NO: 30992 - DNA, 16 bp, Artificial Sequence
  synthetic [barcode part1]
ttccagagtagtgtcg

SEQ ID NO: 30993 - DNA, 16 bp, Artificial Sequence
  synthetic [barcode part1]
agtgataacctgcaag

SEQ ID NO: 30994 - DNA, 16 bp, Artificial Sequence
  synthetic [barcode part1]
gcagttggtcaacact

SEQ ID NO: 30995 - DNA, 16 bp, Artificial Sequence
  synthetic [barcode part1]
cctaagagtgttgcac

SEQ ID NO: 30996 - DNA, 16 bp, Artificial Sequence
  synthetic [barcode part1]
ttctgttgaacggcag

SEQ ID NO: 30997 - DNA, 16 bp, Artificial Sequence
  synthetic [barcode part1]
acttcgacagtcaacg

SEQ ID NO: 30998 - DNA, 16 bp, Artificial Sequence
  synthetic [barcode part1]
tgcaatccaatccttg

SEQ ID NO: 30999 - DNA, 16 bp, Artificial Sequence
  synthetic [barcode part1]
ccgagtcttctgtacg

SEQ ID NO: 31000 - DNA, 16 bp, Artificial Sequence
  synthetic [barcode part1]
aacggttcctctgtgc

SEQ ID NO: 31001 - DNA, 16 bp, Artificial Sequence
  synthetic [barcode part1]
gtctgcgatactcaag

SEQ ID NO: 31002 - DNA, 16 bp, Artificial Sequence
  synthetic [barcode part1]
ccttctggcagttgtg

SEQ ID NO: 31003 - DNA, 16 bp, Artificial Sequence
  synthetic [barcode part1]
atagaacctgcctcag

SEQ ID NO: 31004 - DNA, 16 bp, Artificial Sequence
  synthetic [barcode part1]
taggtggttgcggtag

SEQ ID NO: 31005 - DNA, 16 bp, Artificial Sequence
  synthetic [barcode part1]
gagagaccaaggaatc

SEQ ID NO: 31006 - DNA, 16 bp, Artificial Sequence
  synthetic [barcode part1]
gcgttgaagttcgtgt

SEQ ID NO: 31007 - DNA, 16 bp, Artificial Sequence
  synthetic [barcode part1]
gttcgatcaacaaccg

SEQ ID NO: 31008 - DNA, 16 bp, Artificial Sequence
  synthetic [barcode part1]
tcggtattaacgcgtg

SEQ ID NO: 31009 - DNA, 16 bp, Artificial Sequence
  synthetic [barcode part1]
atcctcagtggtccgt

SEQ ID NO: 31010 - DNA, 16 bp, Artificial Sequence
  synthetic [barcode part1]
aacaacaggacgacag

SEQ ID NO: 31011 - DNA, 16 bp, Artificial Sequence
  synthetic [barcode part1]
gttaagttagaggcgt

SEQ ID NO: 31012 - DNA, 16 bp, Artificial Sequence
  synthetic [barcode part1]
cagtctccttcttgac

SEQ ID NO: 31013 - DNA, 16 bp, Artificial Sequence
  synthetic [barcode part1]
tcctcgattggttctc

SEQ ID NO: 31014 - DNA, 16 bp, Artificial Sequence
  synthetic [barcode part1]
tagtgtggccgtcttc

SEQ ID NO: 31015 - DNA, 16 bp, Artificial Sequence
  synthetic [barcode part1]
ccttgtaggaacgtgt

SEQ ID NO: 31016 - DNA, 16 bp, Artificial Sequence
  synthetic [barcode part1]
tccgactgtgtactgc

SEQ ID NO: 31017 - DNA, 16 bp, Artificial Sequence
  synthetic [barcode part1]
gcgcgagacaacttag

SEQ ID NO: 31018 - DNA, 16 bp, Artificial Sequence
  synthetic [barcode part1]
tcgtgaaggtgtatcc

SEQ ID NO: 31019 - DNA, 16 bp, Artificial Sequence
  synthetic [barcode part1]
actacttagtgtccac

SEQ ID NO: 31020 - DNA, 16 bp, Artificial Sequence
  synthetic [barcode part1]
taattacgtgaggcag

SEQ ID NO: 31021 - DNA, 16 bp, Artificial Sequence
  synthetic [barcode part1]
aacgaccgtcgttagt

SEQ ID NO: 31022 - DNA, 16 bp, Artificial Sequence
  synthetic [barcode part1]
aaggtaaggcagaacc

SEQ ID NO: 31023 - DNA, 16 bp, Artificial Sequence
  synthetic [barcode part1]
ccggcagaagtacagt

SEQ ID NO: 31024 - DNA, 16 bp, Artificial Sequence
  synthetic [barcode part1]
acacctagtcttatcg

SEQ ID NO: 31025 - DNA, 16 bp, Artificial Sequence
  synthetic [barcode part1]
accacctaacagagtc

SEQ ID NO: 31026 - DNA, 16 bp, Artificial Sequence
  synthetic [barcode part1]
cacgacaaggtcttgt

SEQ ID NO: 31027 - DNA, 16 bp, Artificial Sequence
  synthetic [barcode part1]
aaccgtatcgatcttc

SEQ ID NO: 31028 - DNA, 16 bp, Artificial Sequence
  synthetic [barcode part1]
cgaggaggtgtatcgt

SEQ ID NO: 31029 - DNA, 16 bp, Artificial Sequence
  synthetic [barcode part1]
caatcgaagtcctgac

SEQ ID NO: 31030 - DNA, 16 bp, Artificial Sequence
  synthetic [barcode part1]
tgaggcctcagaattc

SEQ ID NO: 31031 - DNA, 16 bp, Artificial Sequence
  synthetic [barcode part1]
ccttacctcgtgagtg

SEQ ID NO: 31032 - DNA, 16 bp, Artificial Sequence
  synthetic [barcode part1]
tacaggtacagacctc

SEQ ID NO: 31033 - DNA, 16 bp, Artificial Sequence
  synthetic [barcode part1]
gagtacgcagtaattg

SEQ ID NO: 31034 - DNA, 16 bp, Artificial Sequence
  synthetic [barcode part1]
tccactcggtgttgtg

SEQ ID NO: 31035 - DNA, 16 bp, Artificial Sequence
  synthetic [barcode part1]
cacttactgcctgtct

SEQ ID NO: 31036 - DNA, 16 bp, Artificial Sequence
  synthetic [barcode part1]
agaacttccacgacgt

SEQ ID NO: 31037 - DNA, 16 bp, Artificial Sequence
  synthetic [barcode part1]
gcctgaactcaagtgt

SEQ ID NO: 31038 - DNA, 16 bp, Artificial Sequence
  synthetic [barcode part1]
aagatagagatccgtc

SEQ ID NO: 31039 - DNA, 16 bp, Artificial Sequence
  synthetic [barcode part1]
tcacagtcagtcagtg

SEQ ID NO: 31040 - DNA, 16 bp, Artificial Sequence
  synthetic [barcode part1]
tctgtgtctgacaact

SEQ ID NO: 31041 - DNA, 16 bp, Artificial Sequence
  synthetic [barcode part1]
actcctacgccggatt

SEQ ID NO: 31042 - DNA, 16 bp, Artificial Sequence
  synthetic [barcode part1]
cgatacgtcaggtgtt

SEQ ID NO: 31043 - DNA, 16 bp, Artificial Sequence
  synthetic [barcode part1]
aacgagaatactcggt

SEQ ID NO: 31044 - DNA, 16 bp, Artificial Sequence
  synthetic [barcode part1]
tgcgagtggtatctgt

SEQ ID NO: 31045 - DNA, 16 bp, Artificial Sequence
  synthetic [barcode part1]
gtgtccgagacagtag

SEQ ID NO: 31046 - DNA, 16 bp, Artificial Sequence
  synthetic [barcode part1]
ccgtggtgatcttaag

SEQ ID NO: 31047 - DNA, 16 bp, Artificial Sequence
  synthetic [barcode part1]
gtagagaatcaccagt

SEQ ID NO: 31048 - DNA, 16 bp, Artificial Sequence
  synthetic [barcode part1]
agacttgtaccaacgc

SEQ ID NO: 31049 - DNA, 16 bp, Artificial Sequence
  synthetic [barcode part1]
gccgcaacttacctac

SEQ ID NO: 31050 - DNA, 16 bp, Artificial Sequence
  synthetic [barcode part1]
tgtatatcgcgcacag

SEQ ID NO: 31051 - DNA, 16 bp, Artificial Sequence
  synthetic [barcode part1]
aagtagtgcactcaag

SEQ ID NO: 31052 - DNA, 16 bp, Artificial Sequence
  synthetic [barcode part1]
caagaaggtcgtgcgt

SEQ ID NO: 31053 - DNA, 16 bp, Artificial Sequence
  synthetic [barcode part1]
tggactaactaccgac

SEQ ID NO: 31054 - DNA, 16 bp, Artificial Sequence
  synthetic [barcode part1]
cacgtcgaatccttcg

SEQ ID NO: 31055 - DNA, 16 bp, Artificial Sequence
  synthetic [barcode part1]
gaataccaggcctatc

SEQ ID NO: 31056 - DNA, 16 bp, Artificial Sequence
  synthetic [barcode part1]
gcgtccagatagagtg

SEQ ID NO: 31057 - DNA, 16 bp, Artificial Sequence
  synthetic [barcode part1]
accagattcaccagac

SEQ ID NO: 31058 - DNA, 16 bp, Artificial Sequence
  synthetic [barcode part1]
cagaggtctcgtattg

SEQ ID NO: 31059 - DNA, 16 bp, Artificial Sequence
  synthetic [barcode part1]
gtaggccactgtcttc

SEQ ID NO: 31060 - DNA, 16 bp, Artificial Sequence
  synthetic [barcode part1]
tggaccacaacctagt

SEQ ID NO: 31061 - DNA, 16 bp, Artificial Sequence
  synthetic [barcode part1]
gaactctggtctcaag

SEQ ID NO: 31062 - DNA, 16 bp, Artificial Sequence
  synthetic [barcode part1]
aggaggtctgcacaac

SEQ ID NO: 31063 - DNA, 16 bp, Artificial Sequence
  synthetic [barcode part1]
gtgttgatccttaacc

SEQ ID NO: 31064 - DNA, 16 bp, Artificial Sequence
  synthetic [barcode part1]
aacactcgcagttgtg

SEQ ID NO: 31065 - DNA, 16 bp, Artificial Sequence
  synthetic [barcode part1]
ccttgtcgaatccacg

SEQ ID NO: 31066 - DNA, 16 bp, Artificial Sequence
  synthetic [barcode part1]
taagtagtggagtctg

SEQ ID NO: 31067 - DNA, 16 bp, Artificial Sequence
  synthetic [barcode part1]
tataccgtcggttccg

SEQ ID NO: 31068 - DNA, 16 bp, Artificial Sequence
  synthetic [barcode part1]
gcgaaggagaggtatt

SEQ ID NO: 31069 - DNA, 16 bp, Artificial Sequence
  synthetic [barcode part1]
ttgagtacctaccgtt

SEQ ID NO: 31070 - DNA, 16 bp, Artificial Sequence
  synthetic [barcode part1]
agtggcctgacttaac

SEQ ID NO: 31071 - DNA, 16 bp, Artificial Sequence
  synthetic [barcode part1]
gcaacagacgaagtag

SEQ ID NO: 31072 - DNA, 16 bp, Artificial Sequence
  synthetic [barcode part1]
cggatacgagacggtt

SEQ ID NO: 31073 - DNA, 16 bp, Artificial Sequence
  synthetic [barcode part1]
cctagagatcacggtt

SEQ ID NO: 31074 - DNA, 16 bp, Artificial Sequence
  synthetic [barcode part1]
tcctaagtacctgttg

SEQ ID NO: 31075 - DNA, 16 bp, Artificial Sequence
  synthetic [barcode part1]
atcgcctaataggacc

SEQ ID NO: 31076 - DNA, 16 bp, Artificial Sequence
  synthetic [barcode part1]
gccgtgattacttatc

SEQ ID NO: 31077 - DNA, 16 bp, Artificial Sequence
  synthetic [barcode part1]
ttacacttgaaccgtc

SEQ ID NO: 31078 - DNA, 16 bp, Artificial Sequence
  synthetic [barcode part1]
tcctgcaagtctgacc

SEQ ID NO: 31079 - DNA, 16 bp, Artificial Sequence
  synthetic [barcode part1]
acacttctccttgcgt

SEQ ID NO: 31080 - DNA, 16 bp, Artificial Sequence
  synthetic [barcode part1]
tataatcctctcgacg

SEQ ID NO: 31081 - DNA, 16 bp, Artificial Sequence
  synthetic [barcode part1]
tgtacctctcaacagt

SEQ ID NO: 31082 - DNA, 16 bp, Artificial Sequence
  synthetic [barcode part1]
atcttgtctgcgtggc

SEQ ID NO: 31083 - DNA, 16 bp, Artificial Sequence
  synthetic [barcode part1]
cctctagacactggtc

SEQ ID NO: 31084 - DNA, 16 bp, Artificial Sequence
  synthetic [barcode part1]
tgattcgtctgacgag

SEQ ID NO: 31085 - DNA, 16 bp, Artificial Sequence
  synthetic [barcode part1]
tactataggccaaccg

SEQ ID NO: 31086 - DNA, 16 bp, Artificial Sequence
  synthetic [barcode part1]
actagtggcggagtac

SEQ ID NO: 31087 - DNA, 16 bp, Artificial Sequence
  synthetic [barcode part1]
agacgaacagagtctt

SEQ ID NO: 31088 - DNA, 16 bp, Artificial Sequence
  synthetic [barcode part1]
cgttccaatagtaggc

SEQ ID NO: 31089 - DNA, 16 bp, Artificial Sequence
  synthetic [barcode part1]
acggcaattgttgtcg

SEQ ID NO: 31090 - DNA, 16 bp, Artificial Sequence
  synthetic [barcode part1]
aggcaggtcacaacgt

SEQ ID NO: 31091 - DNA, 16 bp, Artificial Sequence
  synthetic [barcode part1]
aagaggaccagagttg

SEQ ID NO: 31092 - DNA, 16 bp, Artificial Sequence
  synthetic [barcode part1]
gtgcgcgatatacact

SEQ ID NO: 31093 - DNA, 16 bp, Artificial Sequence
  synthetic [barcode part1]
ttcgcctcgtcacaag

SEQ ID NO: 31094 - DNA, 16 bp, Artificial Sequence
  synthetic [barcode part1]
tactggtagaaggttg

SEQ ID NO: 31095 - DNA, 16 bp, Artificial Sequence
  synthetic [barcode part1]
gagaagactcctcttg

SEQ ID NO: 31096 - DNA, 16 bp, Artificial Sequence
  synthetic [barcode part1]
gtgcacacacaacgtt

SEQ ID NO: 31097 - DNA, 16 bp, Artificial Sequence
  synthetic [barcode part1]
atcggcactacgtagt

SEQ ID NO: 31098 - DNA, 16 bp, Artificial Sequence
  synthetic [barcode part1]
aaccgacggtcttagt

SEQ ID NO: 31099 - DNA, 16 bp, Artificial Sequence
  synthetic [barcode part1]
aacgtaaggacacgag

SEQ ID NO: 31100 - DNA, 16 bp, Artificial Sequence
  synthetic [barcode part1]
atccaccggtagatac

SEQ ID NO: 31101 - DNA, 16 bp, Artificial Sequence
  synthetic [barcode part1]
gccaacgataagatac

SEQ ID NO: 31102 - DNA, 16 bp, Artificial Sequence
  synthetic [barcode part1]
gcgaacttcctattgt

SEQ ID NO: 31103 - DNA, 16 bp, Artificial Sequence
  synthetic [barcode part1]
cgcagatacctcacct

SEQ ID NO: 31104 - DNA, 16 bp, Artificial Sequence
  synthetic [barcode part1]
tacgcggtatcgatac

SEQ ID NO: 31105 - DNA, 16 bp, Artificial Sequence
  synthetic [barcode part1]
agactcaggcaataac

SEQ ID NO: 31106 - DNA, 16 bp, Artificial Sequence
  synthetic [barcode part1]
attgttcgatactcgc

SEQ ID NO: 31107 - DNA, 16 bp, Artificial Sequence
  synthetic [barcode part1]
tagagatcttgacgag

SEQ ID NO: 31108 - DNA, 16 bp, Artificial Sequence
  synthetic [barcode part1]
ttgacagtgccttcgc

SEQ ID NO: 31109 - DNA, 16 bp, Artificial Sequence
  synthetic [barcode part1]
atcggcgatcttccac

SEQ ID NO: 31110 - DNA, 16 bp, Artificial Sequence
  synthetic [barcode part1]
cgagaacctatatccg

SEQ ID NO: 31111 - DNA, 16 bp, Artificial Sequence
  synthetic [barcode part1]
acgactaccagtctcc

SEQ ID NO: 31112 - DNA, 16 bp, Artificial Sequence
  synthetic [barcode part1]
acgcacgtagtattgc

SEQ ID NO: 31113 - DNA, 16 bp, Artificial Sequence
  synthetic [barcode part1]
tcgtccttcggtacag

SEQ ID NO: 31114 - DNA, 16 bp, Artificial Sequence
  synthetic [barcode part1]
acacggttacacgact

SEQ ID NO: 31115 - DNA, 16 bp, Artificial Sequence
  synthetic [barcode part1]
gcggaagtgataatct

SEQ ID NO: 31116 - DNA, 16 bp, Artificial Sequence
  synthetic [barcode part1]
cagtacgtgacggagt

SEQ ID NO: 31117 - DNA, 16 bp, Artificial Sequence
  synthetic [barcode part1]
tgaatccgtaacgaag

SEQ ID NO: 31118 - DNA, 16 bp, Artificial Sequence
  synthetic [barcode part1]
ccgtggactatacaac

SEQ ID NO: 31119 - DNA, 16 bp, Artificial Sequence
  synthetic [barcode part1]
caaggacgtaatctag

SEQ ID NO: 31120 - DNA, 16 bp, Artificial Sequence
  synthetic [barcode part1]
gagtctgtgaagagtt

SEQ ID NO: 31121 - DNA, 16 bp, Artificial Sequence
  synthetic [barcode part1]
gtgagtggacactacg

SEQ ID NO: 31122 - DNA, 16 bp, Artificial Sequence
  synthetic [barcode part1]
atctagagttctgcct

SEQ ID NO: 31123 - DNA, 16 bp, Artificial Sequence
  synthetic [barcode part1]
gttcctacgttgaact

SEQ ID NO: 31124 - DNA, 16 bp, Artificial Sequence
  synthetic [barcode part1]
acgaatatccgaggcg

SEQ ID NO: 31125 - DNA, 16 bp, Artificial Sequence
  synthetic [barcode part1]
cgaacttacagtagag

SEQ ID NO: 31126 - DNA, 16 bp, Artificial Sequence
  synthetic [barcode part1]
ttctggtcgatcctct

SEQ ID NO: 31127 - DNA, 16 bp, Artificial Sequence
  synthetic [barcode part1]
cgagaaggaagttgac

SEQ ID NO: 31128 - DNA, 16 bp, Artificial Sequence
  synthetic [barcode part1]
gtgactaaggaagttc

SEQ ID NO: 31129 - DNA, 16 bp, Artificial Sequence
  synthetic [barcode part1]
actctactcgtcacct

SEQ ID NO: 31130 - DNA, 16 bp, Artificial Sequence
  synthetic [barcode part1]
tggaatccttcctctc

SEQ ID NO: 31131 - DNA, 16 bp, Artificial Sequence
  synthetic [barcode part1]
gatacgcgttacacgt

SEQ ID NO: 31132 - DNA, 16 bp, Artificial Sequence
  synthetic [barcode part1]
cagttgactggtcaac

SEQ ID NO: 31133 - DNA, 16 bp, Artificial Sequence
  synthetic [barcode part1]
gagaggtgcaactgtc

SEQ ID NO: 31134 - DNA, 16 bp, Artificial Sequence
  synthetic [barcode part1]
tactaccgacggtagt

SEQ ID NO: 31135 - DNA, 16 bp, Artificial Sequence
  synthetic [barcode part1]
tctaactccgaaggac

SEQ ID NO: 31136 - DNA, 16 bp, Artificial Sequence
  synthetic [barcode part1]
acacttgactccaccg

SEQ ID NO: 31137 - DNA, 16 bp, Artificial Sequence
  synthetic [barcode part1]
caacgcactaacacgt

SEQ ID NO: 31138 - DNA, 16 bp, Artificial Sequence
  synthetic [barcode part1]
cagtacttctacctag

SEQ ID NO: 31139 - DNA, 16 bp, Artificial Sequence
  synthetic [barcode part1]
cggaactagttgacct

SEQ ID NO: 31140 - DNA, 16 bp, Artificial Sequence
  synthetic [barcode part1]
atcgtccgtccgtaac

SEQ ID NO: 31141 - DNA, 16 bp, Artificial Sequence
  synthetic [barcode part1]
tacgtagtggacctac

SEQ ID NO: 31142 - DNA, 16 bp, Artificial Sequence
  synthetic [barcode part1]
ttgcgtcaacggtctc

SEQ ID NO: 31143 - DNA, 16 bp, Artificial Sequence
  synthetic [barcode part1]
gcaaggtacagtgaag

SEQ ID NO: 31144 - DNA, 16 bp, Artificial Sequence
  synthetic [barcode part1]
acagtgtctaggatcc

SEQ ID NO: 31145 - DNA, 16 bp, Artificial Sequence
  synthetic [barcode part1]
cctaagttctgtggag

SEQ ID NO: 31146 - DNA, 16 bp, Artificial Sequence
  synthetic [barcode part1]
tcctatactgagttgc

SEQ ID NO: 31147 - DNA, 16 bp, Artificial Sequence
  synthetic [barcode part1]
aagaggtgacagtggt

SEQ ID NO: 31148 - DNA, 16 bp, Artificial Sequence
  synthetic [barcode part1]
acctaagatcctgttc

SEQ ID NO: 31149 - DNA, 16 bp, Artificial Sequence
  synthetic [barcode part1]
acttgcaatcgagaag

SEQ ID NO: 31150 - DNA, 16 bp, Artificial Sequence
  synthetic [barcode part1]
aactgtgtcttccggc

SEQ ID NO: 31151 - DNA, 16 bp, Artificial Sequence
  synthetic [barcode part1]
gactacgccaattctt

SEQ ID NO: 31152 - DNA, 16 bp, Artificial Sequence
  synthetic [barcode part1]
cctaattggaggatcc

SEQ ID NO: 31153 - DNA, 16 bp, Artificial Sequence
  synthetic [barcode part1]
tactctaatctgtggc

SEQ ID NO: 31154 - DNA, 16 bp, Artificial Sequence
  synthetic [barcode part1]
gtaactgtgcacgatc

SEQ ID NO: 31155 - DNA, 16 bp, Artificial Sequence
  synthetic [barcode part1]
attctcttgcgtggcg

SEQ ID NO: 31156 - DNA, 16 bp, Artificial Sequence
  synthetic [barcode part1]
gcgtagtctaatctct

SEQ ID NO: 31157 - DNA, 16 bp, Artificial Sequence
  synthetic [barcode part1]
agtcctcaattacgtc

SEQ ID NO: 31158 - DNA, 16 bp, Artificial Sequence
  synthetic [barcode part1]
ttatctgccgcagtgc

SEQ ID NO: 31159 - DNA, 16 bp, Artificial Sequence
  synthetic [barcode part1]
cgcacgaccactattc

SEQ ID NO: 31160 - DNA, 16 bp, Artificial Sequence
  synthetic [barcode part1]
tactgcaaccaaccag

SEQ ID NO: 31161 - DNA, 16 bp, Artificial Sequence
  synthetic [barcode part1]
tgttcacaggcggatt

SEQ ID NO: 31162 - DNA, 16 bp, Artificial Sequence
  synthetic [barcode part1]
gacaagacagtgaggt

SEQ ID NO: 31163 - DNA, 16 bp, Artificial Sequence
  synthetic [barcode part1]
agttcagtgtggaggc

SEQ ID NO: 31164 - DNA, 16 bp, Artificial Sequence
  synthetic [barcode part1]
tggacgacaagacctg

SEQ ID NO: 31165 - DNA, 16 bp, Artificial Sequence
  synthetic [barcode part1]
cagacttaacgaagtg

SEQ ID NO: 31166 - DNA, 16 bp, Artificial Sequence
  synthetic [barcode part1]
gattgaagtggttacg

SEQ ID NO: 31167 - DNA, 16 bp, Artificial Sequence
  synthetic [barcode part1]
tacgatctcttgtcag

SEQ ID NO: 31168 - DNA, 16 bp, Artificial Sequence
  synthetic [barcode part1]
accgacggtaaggtac

SEQ ID NO: 31169 - DNA, 16 bp, Artificial Sequence
  synthetic [barcode part1]
tagacactgacttctc

SEQ ID NO: 31170 - DNA, 16 bp, Artificial Sequence
  synthetic [barcode part1]
tatagttcgtgccgag

SEQ ID NO: 31171 - DNA, 16 bp, Artificial Sequence
  synthetic [barcode part1]
cgtggaagattatcag

SEQ ID NO: 31172 - DNA, 16 bp, Artificial Sequence
  synthetic [barcode part1]
taaccggagtcagtct

SEQ ID NO: 31173 - DNA, 16 bp, Artificial Sequence
  synthetic [barcode part1]
cggatacttcctaact

SEQ ID NO: 31174 - DNA, 16 bp, Artificial Sequence
  synthetic [barcode part1]
tcttacgagtcgttgt

SEQ ID NO: 31175 - DNA, 16 bp, Artificial Sequence
  synthetic [barcode part1]
ataggcgtgccacaag

SEQ ID NO: 31176 - DNA, 16 bp, Artificial Sequence
  synthetic [barcode part1]
gtaccgattaggcgtt

SEQ ID NO: 31177 - DNA, 16 bp, Artificial Sequence
  synthetic [barcode part1]
gaaggtgtattcctgc

SEQ ID NO: 31178 - DNA, 16 bp, Artificial Sequence
  synthetic [barcode part1]
atcaacgccaccactc

SEQ ID NO: 31179 - DNA, 16 bp, Artificial Sequence
  synthetic [barcode part1]
acacggcggttaagac

SEQ ID NO: 31180 - DNA, 16 bp, Artificial Sequence
  synthetic [barcode part1]
taacgatcggcctagt

SEQ ID NO: 31181 - DNA, 16 bp, Artificial Sequence
  synthetic [barcode part1]
ttgagatactcgcctt

SEQ ID NO: 31182 - DNA, 16 bp, Artificial Sequence
  synthetic [barcode part1]
ttgtgtggacttcttg

SEQ ID NO: 31183 - DNA, 16 bp, Artificial Sequence
  synthetic [barcode part1]
aatcgtcaacgatccg

SEQ ID NO: 31184 - DNA, 16 bp, Artificial Sequence
  synthetic [barcode part1]
gtggaccaactatacc

SEQ ID NO: 31185 - DNA, 16 bp, Artificial Sequence
  synthetic [barcode part1]
aggtcactgtcggatt

SEQ ID NO: 31186 - DNA, 16 bp, Artificial Sequence
  synthetic [barcode part1]
cacgtggcactctatc

SEQ ID NO: 31187 - DNA, 16 bp, Artificial Sequence
  synthetic [barcode part1]
cggaatcgagattcct

SEQ ID NO: 31188 - DNA, 16 bp, Artificial Sequence
  synthetic [barcode part1]
aacgcgcaaccaagac

SEQ ID NO: 31189 - DNA, 16 bp, Artificial Sequence
  synthetic [barcode part1]
actgtgtctagacacg

SEQ ID NO: 31190 - DNA, 16 bp, Artificial Sequence
  synthetic [barcode part1]
cacttagaaggtagtg

SEQ ID NO: 31191 - DNA, 16 bp, Artificial Sequence
  synthetic [barcode part1]
cggaaggtcaatctct

SEQ ID NO: 31192 - DNA, 16 bp, Artificial Sequence
  synthetic [barcode part1]
acgaggactaagtcgc

SEQ ID NO: 31193 - DNA, 16 bp, Artificial Sequence
  synthetic [barcode part1]
tgccggtcttcaactg

SEQ ID NO: 31194 - DNA, 16 bp, Artificial Sequence
  synthetic [barcode part1]
tggtgttcaaggttcg

SEQ ID NO: 31195 - DNA, 16 bp, Artificial Sequence
  synthetic [barcode part1]
ttcctatcctgcactg

SEQ ID NO: 31196 - DNA, 16 bp, Artificial Sequence
  synthetic [barcode part1]
tgcagataggcaatac

SEQ ID NO: 31197 - DNA, 16 bp, Artificial Sequence
  synthetic [barcode part1]
cgtcctatacctggac

SEQ ID NO: 31198 - DNA, 16 bp, Artificial Sequence
  synthetic [barcode part1]
ttggacttcgacagtg

SEQ ID NO: 31199 - DNA, 16 bp, Artificial Sequence
  synthetic [barcode part1]
cacttgagtgcgattg

SEQ ID NO: 31200 - DNA, 16 bp, Artificial Sequence
  synthetic [barcode part1]
ataaggatcggcaatc

SEQ ID NO: 31201 - DNA, 16 bp, Artificial Sequence
  synthetic [barcode part1]
aggcaggtagagtcct

SEQ ID NO: 31202 - DNA, 16 bp, Artificial Sequence
  synthetic [barcode part1]
agacactagatctgcc

SEQ ID NO: 31203 - DNA, 16 bp, Artificial Sequence
  synthetic [barcode part1]
gatcggactacacgag

SEQ ID NO: 31204 - DNA, 16 bp, Artificial Sequence
  synthetic [barcode part1]
cctgttcagatagacg

SEQ ID NO: 31205 - DNA, 16 bp, Artificial Sequence
  synthetic [barcode part1]
attgcgattgcagtgc

SEQ ID NO: 31206 - DNA, 16 bp, Artificial Sequence
  synthetic [barcode part1]
tggtcaactaaggtcc

SEQ ID NO: 31207 - DNA, 16 bp, Artificial Sequence
  synthetic [barcode part1]
cacctatcctgttcgt

SEQ ID NO: 31208 - DNA, 16 bp, Artificial Sequence
  synthetic [barcode part1]
ccgtatctgagttgcc

SEQ ID NO: 31209 - DNA, 16 bp, Artificial Sequence
  synthetic [barcode part1]
tagttggcctcaagac

SEQ ID NO: 31210 - DNA, 16 bp, Artificial Sequence
  synthetic [barcode part1]
ttcggagaaccgactt

SEQ ID NO: 31211 - DNA, 16 bp, Artificial Sequence
  synthetic [barcode part1]
caatctgtcgtcagag

SEQ ID NO: 31212 - DNA, 16 bp, Artificial Sequence
  synthetic [barcode part1]
gataggccttgttcag

SEQ ID NO: 31213 - DNA, 16 bp, Artificial Sequence
  synthetic [barcode part1]
ttctgccgaacctacg

SEQ ID NO: 31214 - DNA, 16 bp, Artificial Sequence
  synthetic [barcode part1]
tccgccagttaagagt

SEQ ID NO: 31215 - DNA, 16 bp, Artificial Sequence
  synthetic [barcode part1]
tgcgcagatagttacc

SEQ ID NO: 31216 - DNA, 16 bp, Artificial Sequence
  synthetic [barcode part1]
gccttacggtatattc

SEQ ID NO: 31217 - DNA, 16 bp, Artificial Sequence
  synthetic [barcode part1]
actcggaggtgagact

SEQ ID NO: 31218 - DNA, 16 bp, Artificial Sequence
  synthetic [barcode part1]
acgcacgtcaattgac

SEQ ID NO: 31219 - DNA, 16 bp, Artificial Sequence
  synthetic [barcode part1]
ttcttacgcggcctag

SEQ ID NO: 31220 - DNA, 16 bp, Artificial Sequence
  synthetic [barcode part1]
atccagtaccactgag

SEQ ID NO: 31221 - DNA, 16 bp, Artificial Sequence
  synthetic [barcode part1]
gagttgtaacgtagac

SEQ ID NO: 31222 - DNA, 16 bp, Artificial Sequence
  synthetic [barcode part1]
tcaccgtgaactcgtc

SEQ ID NO: 31223 - DNA, 16 bp, Artificial Sequence
  synthetic [barcode part1]
ccgttcagacaagtac

SEQ ID NO: 31224 - DNA, 16 bp, Artificial Sequence
  synthetic [barcode part1]
ataggcgtgttcactg

SEQ ID NO: 31225 - DNA, 16 bp, Artificial Sequence
  synthetic [barcode part1]
aacttctgccgttctc

SEQ ID NO: 31226 - DNA, 16 bp, Artificial Sequence
  synthetic [barcode part1]
gactgacacactgtgt

SEQ ID NO: 31227 - DNA, 16 bp, Artificial Sequence
  synthetic [barcode part1]
cgtagagttaggttag

SEQ ID NO: 31228 - DNA, 16 bp, Artificial Sequence
  synthetic [barcode part1]
ttaaccgaggacttcg

SEQ ID NO: 31229 - DNA, 16 bp, Artificial Sequence
  synthetic [barcode part1]
gtacgttcggattcag

SEQ ID NO: 31230 - DNA, 16 bp, Artificial Sequence
  synthetic [barcode part1]
tctagaacacacgcgt

SEQ ID NO: 31231 - DNA, 16 bp, Artificial Sequence
  synthetic [barcode part1]
agtcggcactgattac

SEQ ID NO: 31232 - DNA, 16 bp, Artificial Sequence
  synthetic [barcode part1]
cctacgcaactcgact

SEQ ID NO: 31233 - DNA, 16 bp, Artificial Sequence
  synthetic [barcode part1]
ttggtgaacgaaggcc

SEQ ID NO: 31234 - DNA, 16 bp, Artificial Sequence
  synthetic [barcode part1]
tgcacaggagttaagt

SEQ ID NO: 31235 - DNA, 16 bp, Artificial Sequence
  synthetic [barcode part1]
gttagtgaggttgaac

SEQ ID NO: 31236 - DNA, 16 bp, Artificial Sequence
  synthetic [barcode part1]
attgttacgtgaggag

SEQ ID NO: 31237 - DNA, 16 bp, Artificial Sequence
  synthetic [barcode part1]
tattggacaccggact

SEQ ID NO: 31238 - DNA, 16 bp, Artificial Sequence
  synthetic [barcode part1]
ttaatccggtgtgttc

SEQ ID NO: 31239 - DNA, 16 bp, Artificial Sequence
  synthetic [barcode part1]
agtctggtacaagagt

SEQ ID NO: 31240 - DNA, 16 bp, Artificial Sequence
  synthetic [barcode part1]
tactgtctaccagtgt

SEQ ID NO: 31241 - DNA, 16 bp, Artificial Sequence
  synthetic [barcode part1]
attcttgcgccggatc

SEQ ID NO: 31242 - DNA, 16 bp, Artificial Sequence
  synthetic [barcode part1]
gaacttgagtacgtcc

SEQ ID NO: 31243 - DNA, 16 bp, Artificial Sequence
  synthetic [barcode part1]
cgcagatcgagtatct

SEQ ID NO: 31244 - DNA, 16 bp, Artificial Sequence
  synthetic [barcode part1]
tacgtaggaactgaac

SEQ ID NO: 31245 - DNA, 16 bp, Artificial Sequence
  synthetic [barcode part1]
ccaaccttctgcagac

SEQ ID NO: 31246 - DNA, 16 bp, Artificial Sequence
  synthetic [barcode part1]
tgtatctggtaactcc

SEQ ID NO: 31247 - DNA, 16 bp, Artificial Sequence
  synthetic [barcode part1]
tgtaacaggacagact

SEQ ID NO: 31248 - DNA, 16 bp, Artificial Sequence
  synthetic [barcode part1]
aacgattctctgcact

SEQ ID NO: 31249 - DNA, 16 bp, Artificial Sequence
  synthetic [barcode part1]
agattaccaaggacgt

SEQ ID NO: 31250 - DNA, 16 bp, Artificial Sequence
  synthetic [barcode part1]
tcgaaggccttactag

SEQ ID NO: 31251 - DNA, 16 bp, Artificial Sequence
  synthetic [barcode part1]
cgccgaatacttccac

SEQ ID NO: 31252 - DNA, 16 bp, Artificial Sequence
  synthetic [barcode part1]
tctgtaccaacctagt

SEQ ID NO: 31253 - DNA, 16 bp, Artificial Sequence
  synthetic [barcode part1]
acggccactctctaac

SEQ ID NO: 31254 - DNA, 16 bp, Artificial Sequence
  synthetic [barcode part1]
acacaggataggaacg

SEQ ID NO: 31255 - DNA, 16 bp, Artificial Sequence
  synthetic [barcode part1]
ccgtggtaattaaccg

SEQ ID NO: 31256 - DNA, 16 bp, Artificial Sequence
  synthetic [barcode part1]
gttggagattaacgtg

SEQ ID NO: 31257 - DNA, 16 bp, Artificial Sequence
  synthetic [barcode part1]
tcacaagagtggtaac

SEQ ID NO: 31258 - DNA, 16 bp, Artificial Sequence
  synthetic [barcode part1]
gcaggaacaattcaac

SEQ ID NO: 31259 - DNA, 16 bp, Artificial Sequence
  synthetic [barcode part1]
aactatagtcacgcgc

SEQ ID NO: 31260 - DNA, 16 bp, Artificial Sequence
  synthetic [barcode part1]
gtagtcgcaatcacgt

SEQ ID NO: 31261 - DNA, 16 bp, Artificial Sequence
  synthetic [barcode part1]
aggtgcaacgtaagag

SEQ ID NO: 31262 - DNA, 16 bp, Artificial Sequence
  synthetic [barcode part1]
ccgtgtctgtcgagtt

SEQ ID NO: 31263 - DNA, 16 bp, Artificial Sequence
  synthetic [barcode part1]
tccgatcagtcaagac

SEQ ID NO: 31264 - DNA, 16 bp, Artificial Sequence
  synthetic [barcode part1]
tgtgacttgcaggttg

SEQ ID NO: 31265 - DNA, 16 bp, Artificial Sequence
  synthetic [barcode part1]
tgtcgtccttaacctc

SEQ ID NO: 31266 - DNA, 16 bp, Artificial Sequence
  synthetic [barcode part1]
gcgaagatcagaccac

SEQ ID NO: 31267 - DNA, 16 bp, Artificial Sequence
  synthetic [barcode part1]
agacggtagttacgcg

SEQ ID NO: 31268 - DNA, 16 bp, Artificial Sequence
  synthetic [barcode part1]
tccagtctgacgtgtc

SEQ ID NO: 31269 - DNA, 16 bp, Artificial Sequence
  synthetic [barcode part1]
attcgttcaggtaggc

SEQ ID NO: 31270 - DNA, 16 bp, Artificial Sequence
  synthetic [barcode part1]
tactgtgcacaacgtg

SEQ ID NO: 31271 - DNA, 16 bp, Artificial Sequence
  synthetic [barcode part1]
taactctattgacgcc

SEQ ID NO: 31272 - DNA, 16 bp, Artificial Sequence
  synthetic [barcode part1]
aggaggcgataacagt

SEQ ID NO: 31273 - DNA, 16 bp, Artificial Sequence
  synthetic [barcode part1]
ttcacgcaaggtacac

SEQ ID NO: 31274 - DNA, 16 bp, Artificial Sequence
  synthetic [barcode part1]
cgtgcaataggttcgt

SEQ ID NO: 31275 - DNA, 16 bp, Artificial Sequence
  synthetic [barcode part1]
tatcggaggtgacttc

SEQ ID NO: 31276 - DNA, 16 bp, Artificial Sequence
  synthetic [barcode part1]
tacgaaccgtctagac

SEQ ID NO: 31277 - DNA, 16 bp, Artificial Sequence
  synthetic [barcode part1]
tgattcgttcgcgtcg

SEQ ID NO: 31278 - DNA, 16 bp, Artificial Sequence
  synthetic [barcode part1]
agaacggatccgcaac

SEQ ID NO: 31279 - DNA, 16 bp, Artificial Sequence
  synthetic [barcode part1]
tcgcggagacgataac

SEQ ID NO: 31280 - DNA, 16 bp, Artificial Sequence
  synthetic [barcode part1]
gcactgagactgtact

SEQ ID NO: 31281 - DNA, 16 bp, Artificial Sequence
  synthetic [barcode part1]
attgcaagacaggtgt

SEQ ID NO: 31282 - DNA, 16 bp, Artificial Sequence
  synthetic [barcode part1]
gaggacaattcaacac

SEQ ID NO: 31283 - DNA, 16 bp, Artificial Sequence
  synthetic [barcode part1]
ttccgacgattcgcac

SEQ ID NO: 31284 - DNA, 16 bp, Artificial Sequence
  synthetic [barcode part1]
cgtgacgacggataac

SEQ ID NO: 31285 - DNA, 16 bp, Artificial Sequence
  synthetic [barcode part1]
tcctaagatagacgag

SEQ ID NO: 31286 - DNA, 16 bp, Artificial Sequence
  synthetic [barcode part1]
agttcaaggtcgtcgt

SEQ ID NO: 31287 - DNA, 16 bp, Artificial Sequence
  synthetic [barcode part1]
tacgcgaatcctccgt

SEQ ID NO: 31288 - DNA, 16 bp, Artificial Sequence
  synthetic [barcode part1]
atcacgactcgcctac

SEQ ID NO: 31289 - DNA, 16 bp, Artificial Sequence
  synthetic [barcode part1]
tcaccacttacaagtc

SEQ ID NO: 31290 - DNA, 16 bp, Artificial Sequence
  synthetic [barcode part1]
tgagtgttggtagaac

SEQ ID NO: 31291 - DNA, 16 bp, Artificial Sequence
  synthetic [barcode part1]
cagtgaccacagaggt

SEQ ID NO: 31292 - DNA, 16 bp, Artificial Sequence
  synthetic [barcode part1]
ttactacggcacttac

SEQ ID NO: 31293 - DNA, 16 bp, Artificial Sequence
  synthetic [barcode part1]
aagtaaggcgagtgac

SEQ ID NO: 31294 - DNA, 16 bp, Artificial Sequence
  synthetic [barcode part1]
cagtagttcggatcac

SEQ ID NO: 31295 - DNA, 16 bp, Artificial Sequence
  synthetic [barcode part1]
caggacaataatcacg

SEQ ID NO: 31296 - DNA, 16 bp, Artificial Sequence
  synthetic [barcode part1]
aatcaccttgtcggag

SEQ ID NO: 31297 - DNA, 16 bp, Artificial Sequence
  synthetic [barcode part1]
taactctgcgtgttac

SEQ ID NO: 31298 - DNA, 16 bp, Artificial Sequence
  synthetic [barcode part1]
gatatcgattacggcc

SEQ ID NO: 31299 - DNA, 16 bp, Artificial Sequence
  synthetic [barcode part1]
aaggtgcaggatacag

SEQ ID NO: 31300 - DNA, 16 bp, Artificial Sequence
  synthetic [barcode part1]
attgccactctcgcag

SEQ ID NO: 31301 - DNA, 16 bp, Artificial Sequence
  synthetic [barcode part1]
acagtgcaatcggtct

SEQ ID NO: 31302 - DNA, 16 bp, Artificial Sequence
  synthetic [barcode part1]
acttgaggaacctacc

SEQ ID NO: 31303 - DNA, 16 bp, Artificial Sequence
  synthetic [barcode part1]
tcgtctggacgttgtc

SEQ ID NO: 31304 - DNA, 16 bp, Artificial Sequence
  synthetic [barcode part1]
gcggattgagaattgt

SEQ ID NO: 31305 - DNA, 16 bp, Artificial Sequence
  synthetic [barcode part1]
tactgagtgccagatc

SEQ ID NO: 31306 - DNA, 16 bp, Artificial Sequence
  synthetic [barcode part1]
caaggaatcggtctct

SEQ ID NO: 31307 - DNA, 16 bp, Artificial Sequence
  synthetic [barcode part1]
gcaatacttccaaggc

SEQ ID NO: 31308 - DNA, 16 bp, Artificial Sequence
  synthetic [barcode part1]
tacttgcagatcctgt

SEQ ID NO: 31309 - DNA, 16 bp, Artificial Sequence
  synthetic [barcode part1]
cgtgtataggaccttg

SEQ ID NO: 31310 - DNA, 16 bp, Artificial Sequence
  synthetic [barcode part1]
acgttgacggtaggac

SEQ ID NO: 31311 - DNA, 16 bp, Artificial Sequence
  synthetic [barcode part1]
acgagagactactggc

SEQ ID NO: 31312 - DNA, 16 bp, Artificial Sequence
  synthetic [barcode part1]
acgatactctctcctc

SEQ ID NO: 31313 - DNA, 16 bp, Artificial Sequence
  synthetic [barcode part1]
attgcactgtagaccg

SEQ ID NO: 31314 - DNA, 16 bp, Artificial Sequence
  synthetic [barcode part1]
atcacagtactcgttc

SEQ ID NO: 31315 - DNA, 16 bp, Artificial Sequence
  synthetic [barcode part1]
tgaactgtgtgcctcc

SEQ ID NO: 31316 - DNA, 16 bp, Artificial Sequence
  synthetic [barcode part1]
atatctctgatccgac

SEQ ID NO: 31317 - DNA, 16 bp, Artificial Sequence
  synthetic [barcode part1]
tctcaaccgtaagtct

SEQ ID NO: 31318 - DNA, 16 bp, Artificial Sequence
  synthetic [barcode part1]
actacagaggtcttgc

SEQ ID NO: 31319 - DNA, 16 bp, Artificial Sequence
  synthetic [barcode part1]
gttaccaattaggccg

SEQ ID NO: 31320 - DNA, 16 bp, Artificial Sequence
  synthetic [barcode part1]
attgacgaagtcagac

SEQ ID NO: 31321 - DNA, 16 bp, Artificial Sequence
  synthetic [barcode part1]
cgtagacgaacctact

SEQ ID NO: 31322 - DNA, 16 bp, Artificial Sequence
  synthetic [barcode part1]
ttcggtacgaatcgtg

SEQ ID NO: 31323 - DNA, 16 bp, Artificial Sequence
  synthetic [barcode part1]
gcagagtagactcgtg

SEQ ID NO: 31324 - DNA, 16 bp, Artificial Sequence
  synthetic [barcode part1]
tattagaggcacagac

SEQ ID NO: 31325 - DNA, 16 bp, Artificial Sequence
  synthetic [barcode part1]
agacttcgcgtatacg

SEQ ID NO: 31326 - DNA, 16 bp, Artificial Sequence
  synthetic [barcode part1]
cgtaggccgttacttc

SEQ ID NO: 31327 - DNA, 16 bp, Artificial Sequence
  synthetic [barcode part1]
aggacttgtgacactc

SEQ ID NO: 31328 - DNA, 16 bp, Artificial Sequence
  synthetic [barcode part1]
ccgattccagaagatc

SEQ ID NO: 31329 - DNA, 16 bp, Artificial Sequence
  synthetic [barcode part1]
gtgattctgttctcag

SEQ ID NO: 31330 - DNA, 16 bp, Artificial Sequence
  synthetic [barcode part1]
cggttggttaattggc

SEQ ID NO: 31331 - DNA, 16 bp, Artificial Sequence
  synthetic [barcode part1]
gtatacgtacgcgtac

SEQ ID NO: 31332 - DNA, 16 bp, Artificial Sequence
  synthetic [barcode part1]
ccagtctcactaacgc

SEQ ID NO: 31333 - DNA, 16 bp, Artificial Sequence
  synthetic [barcode part1]
cctgacctagtatact

SEQ ID NO: 31334 - DNA, 16 bp, Artificial Sequence
  synthetic [barcode part1]
ttcttggcgcgcagtt

SEQ ID NO: 31335 - DNA, 16 bp, Artificial Sequence
  synthetic [barcode part1]
tgcaagttctgaacgc

SEQ ID NO: 31336 - DNA, 16 bp, Artificial Sequence
  synthetic [barcode part1]
gactcctgcacttgac

SEQ ID NO: 31337 - DNA, 16 bp, Artificial Sequence
  synthetic [barcode part1]
ttacggtcgacactag

SEQ ID NO: 31338 - DNA, 16 bp, Artificial Sequence
  synthetic [barcode part1]
acaacctggacacgag

SEQ ID NO: 31339 - DNA, 16 bp, Artificial Sequence
  synthetic [barcode part1]
tgcgaaccgaagtggt

SEQ ID NO: 31340 - DNA, 16 bp, Artificial Sequence
  synthetic [barcode part1]
tcactgtaagtccgtt

SEQ ID NO: 31341 - DNA, 16 bp, Artificial Sequence
  synthetic [barcode part1]
gtacggcctagagaac

SEQ ID NO: 31342 - DNA, 16 bp, Artificial Sequence
  synthetic [barcode part1]
atcaacggccttccac

SEQ ID NO: 31343 - DNA, 16 bp, Artificial Sequence
  synthetic [barcode part1]
tacaacggagtgaatc

SEQ ID NO: 31344 - DNA, 16 bp, Artificial Sequence
  synthetic [barcode part1]
ttcggcgattctcgtg

SEQ ID NO: 31345 - DNA, 16 bp, Artificial Sequence
  synthetic [barcode part1]
cacgcctaatagtctt

SEQ ID NO: 31346 - DNA, 16 bp, Artificial Sequence
  synthetic [barcode part1]
aactcggatcagacct

SEQ ID NO: 31347 - DNA, 16 bp, Artificial Sequence
  synthetic [barcode part1]
tcttcaggtcagtact

SEQ ID NO: 31348 - DNA, 16 bp, Artificial Sequence
  synthetic [barcode part1]
ttcctctgccaactac

SEQ ID NO: 31349 - DNA, 16 bp, Artificial Sequence
  synthetic [barcode part1]
tccgtaacttgttacg

SEQ ID NO: 31350 - DNA, 16 bp, Artificial Sequence
  synthetic [barcode part1]
gcaacgtgttggttgt

SEQ ID NO: 31351 - DNA, 16 bp, Artificial Sequence
  synthetic [barcode part1]
ccgcctacactgtagt

SEQ ID NO: 31352 - DNA, 16 bp, Artificial Sequence
  synthetic [barcode part1]
gtcgaagataccgacg

SEQ ID NO: 31353 - DNA, 16 bp, Artificial Sequence
  synthetic [barcode part1]
ttccgtaactgccggt

SEQ ID NO: 31354 - DNA, 16 bp, Artificial Sequence
  synthetic [barcode part1]
gattctccgacctctt

SEQ ID NO: 31355 - DNA, 16 bp, Artificial Sequence
  synthetic [barcode part1]
ttcgcgtagagtacac

SEQ ID NO: 31356 - DNA, 16 bp, Artificial Sequence
  synthetic [barcode part1]
cagtgttgcaacactg

SEQ ID NO: 31357 - DNA, 16 bp, Artificial Sequence
  synthetic [barcode part1]
aagtgttcgtccaggt

SEQ ID NO: 31358 - DNA, 16 bp, Artificial Sequence
  synthetic [barcode part1]
tgtcagacaccttcgc

SEQ ID NO: 31359 - DNA, 16 bp, Artificial Sequence
  synthetic [barcode part1]
ccactggtaacagttg

SEQ ID NO: 31360 - DNA, 16 bp, Artificial Sequence
  synthetic [barcode part1]
acgagacttacaggcg

SEQ ID NO: 31361 - DNA, 16 bp, Artificial Sequence
  synthetic [barcode part1]
tgagtggagatcttag

SEQ ID NO: 31362 - DNA, 16 bp, Artificial Sequence
  synthetic [barcode part1]
actggcaagattaggt

SEQ ID NO: 31363 - DNA, 16 bp, Artificial Sequence
  synthetic [barcode part1]
agatcgcctgcgtctt

SEQ ID NO: 31364 - DNA, 16 bp, Artificial Sequence
  synthetic [barcode part1]
tctgacctacacggtc

SEQ ID NO: 31365 - DNA, 16 bp, Artificial Sequence
  synthetic [barcode part1]
aataggagtatctggc

SEQ ID NO: 31366 - DNA, 16 bp, Artificial Sequence
  synthetic [barcode part1]
taccaacctagagaag

SEQ ID NO: 31367 - DNA, 16 bp, Artificial Sequence
  synthetic [barcode part1]
tgcaggcaccttgttc

SEQ ID NO: 31368 - DNA, 16 bp, Artificial Sequence
  synthetic [barcode part1]
tcacttgcggaatctt

SEQ ID NO: 31369 - DNA, 16 bp, Artificial Sequence
  synthetic [barcode part1]
aagtccaagatcagac

SEQ ID NO: 31370 - DNA, 16 bp, Artificial Sequence
  synthetic [barcode part1]
accacaactacttgtc

SEQ ID NO: 31371 - DNA, 16 bp, Artificial Sequence
  synthetic [barcode part1]
gttgcgattatccgtt

SEQ ID NO: 31372 - DNA, 16 bp, Artificial Sequence
  synthetic [barcode part1]
gacgtgtctccgactt

SEQ ID NO: 31373 - DNA, 16 bp, Artificial Sequence
  synthetic [barcode part1]
tgacactcgcctactg

SEQ ID NO: 31374 - DNA, 16 bp, Artificial Sequence
  synthetic [barcode part1]
gtgtggtgtgtcaact

SEQ ID NO: 31375 - DNA, 16 bp, Artificial Sequence
  synthetic [barcode part1]
gttaacactacgcggt

SEQ ID NO: 31376 - DNA, 16 bp, Artificial Sequence
  synthetic [barcode part1]
tcctcgtcaggttgtg

SEQ ID NO: 31377 - DNA, 16 bp, Artificial Sequence
  synthetic [barcode part1]
gtcgtccacaggtctt

SEQ ID NO: 31378 - DNA, 16 bp, Artificial Sequence
  synthetic [barcode part1]
acttaggacgacggac

SEQ ID NO: 31379 - DNA, 16 bp, Artificial Sequence
  synthetic [barcode part1]
tcgaacgttgtggact

SEQ ID NO: 31380 - DNA, 16 bp, Artificial Sequence
  synthetic [barcode part1]
gttggattccggtaac

SEQ ID NO: 31381 - DNA, 16 bp, Artificial Sequence
  synthetic [barcode part1]
cagatcgaacctgact

SEQ ID NO: 31382 - DNA, 16 bp, Artificial Sequence
  synthetic [barcode part1]
ttgcaacgtgtacgtg

SEQ ID NO: 31383 - DNA, 16 bp, Artificial Sequence
  synthetic [barcode part1]
cctacaacgaggtgag

SEQ ID NO: 31384 - DNA, 16 bp, Artificial Sequence
  synthetic [barcode part1]
gaagacaacgacttgt

SEQ ID NO: 31385 - DNA, 16 bp, Artificial Sequence
  synthetic [barcode part1]
gtagactcgtatcgac

SEQ ID NO: 31386 - DNA, 16 bp, Artificial Sequence
  synthetic [barcode part1]
ttactgccgtctaagt

SEQ ID NO: 31387 - DNA, 16 bp, Artificial Sequence
  synthetic [barcode part1]
ccgatctacgattatc

SEQ ID NO: 31388 - DNA, 16 bp, Artificial Sequence
  synthetic [barcode part1]
tgacgatctcctgtgc

SEQ ID NO: 31389 - DNA, 16 bp, Artificial Sequence
  synthetic [barcode part1]
gcacacagtgtacgtt

SEQ ID NO: 31390 - DNA, 16 bp, Artificial Sequence
  synthetic [barcode part1]
gagttaacagtgtgtg

SEQ ID NO: 31391 - DNA, 16 bp, Artificial Sequence
  synthetic [barcode part1]
acgcggtctaaggaac

SEQ ID NO: 31392 - DNA, 16 bp, Artificial Sequence
  synthetic [barcode part1]
ccgcaagttactattc

SEQ ID NO: 31393 - DNA, 16 bp, Artificial Sequence
  synthetic [barcode part1]
ttgaacggagtgacgc

SEQ ID NO: 31394 - DNA, 16 bp, Artificial Sequence
  synthetic [barcode part1]
gaagagtgtccaagtt

SEQ ID NO: 31395 - DNA, 16 bp, Artificial Sequence
  synthetic [barcode part1]
accgtgaggataagtt

SEQ ID NO: 31396 - DNA, 16 bp, Artificial Sequence
  synthetic [barcode part1]
tcagtggcctatactt

SEQ ID NO: 31397 - DNA, 16 bp, Artificial Sequence
  synthetic [barcode part1]
accactaagttcggtg

SEQ ID NO: 31398 - DNA, 16 bp, Artificial Sequence
  synthetic [barcode part1]
cagtactaggttccag

SEQ ID NO: 31399 - DNA, 16 bp, Artificial Sequence
  synthetic [barcode part1]
gaacctgacgactgtt

SEQ ID NO: 31400 - DNA, 16 bp, Artificial Sequence
  synthetic [barcode part1]
cggtaaggcgaatctg

SEQ ID NO: 31401 - DNA, 16 bp, Artificial Sequence
  synthetic [barcode part1]
tgatcactaccggtag

SEQ ID NO: 31402 - DNA, 16 bp, Artificial Sequence
  synthetic [barcode part1]
ccgcaggagatcaagt

SEQ ID NO: 31403 - DNA, 16 bp, Artificial Sequence
  synthetic [barcode part1]
aatacgtgttgcgcgt

SEQ ID NO: 31404 - DNA, 16 bp, Artificial Sequence
  synthetic [barcode part1]
gacggtactgcaagtg

SEQ ID NO: 31405 - DNA, 16 bp, Artificial Sequence
  synthetic [barcode part1]
gtggcaattgtgcgag

SEQ ID NO: 31406 - DNA, 16 bp, Artificial Sequence
  synthetic [barcode part1]
tgattcggtctggtag

SEQ ID NO: 31407 - DNA, 16 bp, Artificial Sequence
  synthetic [barcode part1]
tgcgaattaaggcggc

SEQ ID NO: 31408 - DNA, 16 bp, Artificial Sequence
  synthetic [barcode part1]
gactacgttctgatct

SEQ ID NO: 31409 - DNA, 16 bp, Artificial Sequence
  synthetic [barcode part1]
cggtagtgattcgact

SEQ ID NO: 31410 - DNA, 16 bp, Artificial Sequence
  synthetic [barcode part1]
gttgtagtaggacctc

SEQ ID NO: 31411 - DNA, 16 bp, Artificial Sequence
  synthetic [barcode part1]
gatccagaatcaccgt

SEQ ID NO: 31412 - DNA, 16 bp, Artificial Sequence
  synthetic [barcode part1]
cgtccgtatcttaagt

SEQ ID NO: 31413 - DNA, 16 bp, Artificial Sequence
  synthetic [barcode part1]
atctgtcacaacgtct

SEQ ID NO: 31414 - DNA, 16 bp, Artificial Sequence
  synthetic [barcode part1]
ccggcctaacgtattc

SEQ ID NO: 31415 - DNA, 16 bp, Artificial Sequence
  synthetic [barcode part1]
tacacgtggttagtcg

SEQ ID NO: 31416 - DNA, 16 bp, Artificial Sequence
  synthetic [barcode part1]
gaattcgactcagacc

SEQ ID NO: 31417 - DNA, 16 bp, Artificial Sequence
  synthetic [barcode part1]
cctggaatcaactggt

SEQ ID NO: 31418 - DNA, 16 bp, Artificial Sequence
  synthetic [barcode part1]
acactcttgcgtctct

SEQ ID NO: 31419 - DNA, 16 bp, Artificial Sequence
  synthetic [barcode part1]
taagactgtgtcgcgt

SEQ ID NO: 31420 - DNA, 16 bp, Artificial Sequence
  synthetic [barcode part1]
tgttgtggatcaaccg

SEQ ID NO: 31421 - DNA, 16 bp, Artificial Sequence
  synthetic [barcode part1]
ttctgtaggtccgacc

SEQ ID NO: 31422 - DNA, 16 bp, Artificial Sequence
  synthetic [barcode part1]
tcacctgacttgtctc

SEQ ID NO: 31423 - DNA, 16 bp, Artificial Sequence
  synthetic [barcode part1]
gttctgttgaacctgt

SEQ ID NO: 31424 - DNA, 16 bp, Artificial Sequence
  synthetic [barcode part1]
actgtacctgaacacg

SEQ ID NO: 31425 - DNA, 16 bp, Artificial Sequence
  synthetic [barcode part1]
tattcgccagaacctt

SEQ ID NO: 31426 - DNA, 16 bp, Artificial Sequence
  synthetic [barcode part1]
acgcggtaggattgac

SEQ ID NO: 31427 - DNA, 16 bp, Artificial Sequence
  synthetic [barcode part1]
tatcgttagtacgtcc

SEQ ID NO: 31428 - DNA, 16 bp, Artificial Sequence
  synthetic [barcode part1]
agatccggagttaagt

SEQ ID NO: 31429 - DNA, 16 bp, Artificial Sequence
  synthetic [barcode part1]
attggtactgccactt

SEQ ID NO: 31430 - DNA, 16 bp, Artificial Sequence
  synthetic [barcode part1]
gacacttcaagaggcg

SEQ ID NO: 31431 - DNA, 16 bp, Artificial Sequence
  synthetic [barcode part1]
tcggttccttgtaggc

SEQ ID NO: 31432 - DNA, 16 bp, Artificial Sequence
  synthetic [barcode part1]
cggtacagattgcact

SEQ ID NO: 31433 - DNA, 16 bp, Artificial Sequence
  synthetic [barcode part1]
ttggtgttggtacgtg

SEQ ID NO: 31434 - DNA, 16 bp, Artificial Sequence
  synthetic [barcode part1]
gagaacacctaacagt

SEQ ID NO: 31435 - DNA, 16 bp, Artificial Sequence
  synthetic [barcode part1]
taagagtaggtgcgag

SEQ ID NO: 31436 - DNA, 16 bp, Artificial Sequence
  synthetic [barcode part1]
tgacgcagaaggtcgt

SEQ ID NO: 31437 - DNA, 16 bp, Artificial Sequence
  synthetic [barcode part1]
tggactagaagtgcgc

SEQ ID NO: 31438 - DNA, 16 bp, Artificial Sequence
  synthetic [barcode part1]
ttcgaccgtatactac

SEQ ID NO: 31439 - DNA, 16 bp, Artificial Sequence
  synthetic [barcode part1]
ttgattcggatcaggc

SEQ ID NO: 31440 - DNA, 16 bp, Artificial Sequence
  synthetic [barcode part1]
gaacctgagtggcagt

SEQ ID NO: 31441 - DNA, 16 bp, Artificial Sequence
  synthetic [barcode part1]
cagacagaatactgtg

SEQ ID NO: 31442 - DNA, 16 bp, Artificial Sequence
  synthetic [barcode part1]
gcagtgttggtcagtt

SEQ ID NO: 31443 - DNA, 16 bp, Artificial Sequence
  synthetic [barcode part1]
tgcgtctaacaatctc

SEQ ID NO: 31444 - DNA, 16 bp, Artificial Sequence
  synthetic [barcode part1]
aaggcagacaataggc

SEQ ID NO: 31445 - DNA, 16 bp, Artificial Sequence
  synthetic [barcode part1]
caatattctgtccacg

SEQ ID NO: 31446 - DNA, 16 bp, Artificial Sequence
  synthetic [barcode part1]
accacctctacgagtc

SEQ ID NO: 31447 - DNA, 16 bp, Artificial Sequence
  synthetic [barcode part1]
aggacagatctcgttc

SEQ ID NO: 31448 - DNA, 16 bp, Artificial Sequence
  synthetic [barcode part1]
tggataccttcgttac

SEQ ID NO: 31449 - DNA, 16 bp, Artificial Sequence
  synthetic [barcode part1]
gaataaccggtgagag

SEQ ID NO: 31450 - DNA, 16 bp, Artificial Sequence
  synthetic [barcode part1]
gtcgtattctctaacg

SEQ ID NO: 31451 - DNA, 16 bp, Artificial Sequence
  synthetic [barcode part1]
tgttggtctgaagaag

SEQ ID NO: 31452 - DNA, 16 bp, Artificial Sequence
  synthetic [barcode part1]
ccacaattacagtgcg

SEQ ID NO: 31453 - DNA, 16 bp, Artificial Sequence
  synthetic [barcode part1]
gaggatcgttgtgcag

SEQ ID NO: 31454 - DNA, 16 bp, Artificial Sequence
  synthetic [barcode part1]
gtcctactagagaacc

SEQ ID NO: 31455 - DNA, 16 bp, Artificial Sequence
  synthetic [barcode part1]
ccttcgagttgacacc

SEQ ID NO: 31456 - DNA, 16 bp, Artificial Sequence
  synthetic [barcode part1]
tacaccaagaatcgag

SEQ ID NO: 31457 - DNA, 16 bp, Artificial Sequence
  synthetic [barcode part1]
gcgttcgaacaagacg

SEQ ID NO: 31458 - DNA, 16 bp, Artificial Sequence
  synthetic [barcode part1]
tgcaacagtcttaggc

SEQ ID NO: 31459 - DNA, 16 bp, Artificial Sequence
  synthetic [barcode part1]
cgttaacgaagaatcg

SEQ ID NO: 31460 - DNA, 16 bp, Artificial Sequence
  synthetic [barcode part1]
aacggtctgcgtcctt

SEQ ID NO: 31461 - DNA, 16 bp, Artificial Sequence
  synthetic [barcode part1]
tacacacacgtacacg

SEQ ID NO: 31462 - DNA, 16 bp, Artificial Sequence
  synthetic [barcode part1]
gtcgatatctgtaggc

SEQ ID NO: 31463 - DNA, 16 bp, Artificial Sequence
  synthetic [barcode part1]
tggcagagtccgtaag

SEQ ID NO: 31464 - DNA, 16 bp, Artificial Sequence
  synthetic [barcode part1]
tcgcagattgttacct

SEQ ID NO: 31465 - DNA, 16 bp, Artificial Sequence
  synthetic [barcode part1]
tctggccgtgtgttgt

SEQ ID NO: 31466 - DNA, 16 bp, Artificial Sequence
  synthetic [barcode part1]
ttcggtactcgtaccg

SEQ ID NO: 31467 - DNA, 16 bp, Artificial Sequence
  synthetic [barcode part1]
cagttcctgcgattgc

SEQ ID NO: 31468 - DNA, 16 bp, Artificial Sequence
  synthetic [barcode part1]
gagttcgaccttccgt

SEQ ID NO: 31469 - DNA, 16 bp, Artificial Sequence
  synthetic [barcode part1]
attaggcaagtgtgac

SEQ ID NO: 31470 - DNA, 16 bp, Artificial Sequence
  synthetic [barcode part1]
gttataaggcggatac

SEQ ID NO: 31471 - DNA, 16 bp, Artificial Sequence
  synthetic [barcode part1]
gtgtcttagtcgttgt

SEQ ID NO: 31472 - DNA, 16 bp, Artificial Sequence
  synthetic [barcode part1]
gcgttctgactactgc

SEQ ID NO: 31473 - DNA, 16 bp, Artificial Sequence
  synthetic [barcode part1]
cgttctgtcacttcac

SEQ ID NO: 31474 - DNA, 16 bp, Artificial Sequence
  synthetic [barcode part1]
acgttcaggatctgtg

SEQ ID NO: 31475 - DNA, 16 bp, Artificial Sequence
  synthetic [barcode part1]
acctgtacgtgagttg

SEQ ID NO: 31476 - DNA, 16 bp, Artificial Sequence
  synthetic [barcode part1]
gtggtagataactacg

SEQ ID NO: 31477 - DNA, 16 bp, Artificial Sequence
  synthetic [barcode part1]
gacctgacctctgtgt

SEQ ID NO: 31478 - DNA, 16 bp, Artificial Sequence
  synthetic [barcode part1]
actcgaatctaggcac

SEQ ID NO: 31479 - DNA, 16 bp, Artificial Sequence
  synthetic [barcode part1]
tcaggttgaggacacg

SEQ ID NO: 31480 - DNA, 16 bp, Artificial Sequence
  synthetic [barcode part1]
cagtacttaggatccg

SEQ ID NO: 31481 - DNA, 16 bp, Artificial Sequence
  synthetic [barcode part1]
acgtcggccttgttac

SEQ ID NO: 31482 - DNA, 16 bp, Artificial Sequence
  synthetic [barcode part1]
aagtagagacgagtgc

SEQ ID NO: 31483 - DNA, 16 bp, Artificial Sequence
  synthetic [barcode part1]
aagacgactcgtcgtt

SEQ ID NO: 31484 - DNA, 16 bp, Artificial Sequence
  synthetic [barcode part1]
taacaatctctgcgtc

SEQ ID NO: 31485 - DNA, 16 bp, Artificial Sequence
  synthetic [barcode part1]
gtacgcgaagattctc

SEQ ID NO: 31486 - DNA, 16 bp, Artificial Sequence
  synthetic [barcode part1]
actgacgacctcctgt

SEQ ID NO: 31487 - DNA, 16 bp, Artificial Sequence
  synthetic [barcode part1]
gacttggcagtctagt

SEQ ID NO: 31488 - DNA, 16 bp, Artificial Sequence
  synthetic [barcode part1]
atacttcaccgagttc

SEQ ID NO: 31489 - DNA, 16 bp, Artificial Sequence
  synthetic [barcode part1]
cgttccttagtagttg

SEQ ID NO: 31490 - DNA, 16 bp, Artificial Sequence
  synthetic [barcode part1]
cctcttgtagaagacg

SEQ ID NO: 31491 - DNA, 16 bp, Artificial Sequence
  synthetic [barcode part1]
cagtctaggatcactg

SEQ ID NO: 31492 - DNA, 16 bp, Artificial Sequence
  synthetic [barcode part1]
gagtgagaataggtgc

SEQ ID NO: 31493 - DNA, 16 bp, Artificial Sequence
  synthetic [barcode part1]
tcgtgtaaggactaag

SEQ ID NO: 31494 - DNA, 16 bp, Artificial Sequence
  synthetic [barcode part1]
gtacggtctggtcctt

SEQ ID NO: 31495 - DNA, 16 bp, Artificial Sequence
  synthetic [barcode part1]
tgtgtacacacgtacg

SEQ ID NO: 31496 - DNA, 16 bp, Artificial Sequence
  synthetic [barcode part1]
ccagagtctcggaatt

SEQ ID NO: 31497 - DNA, 16 bp, Artificial Sequence
  synthetic [barcode part1]
tcagagtggcgagtac

SEQ ID NO: 31498 - DNA, 16 bp, Artificial Sequence
  synthetic [barcode part1]
cacttgagaagactag

SEQ ID NO: 31499 - DNA, 16 bp, Artificial Sequence
  synthetic [barcode part1]
tagttcggtctctgcg

SEQ ID NO: 31500 - DNA, 16 bp, Artificial Sequence
  synthetic [barcode part1]
tgtagtggtccgtctc

SEQ ID NO: 31501 - DNA, 16 bp, Artificial Sequence
  synthetic [barcode part1]
ttccacgttaggtcgc

SEQ ID NO: 31502 - DNA, 16 bp, Artificial Sequence
  synthetic [barcode part1]
acagacctccttagtt

SEQ ID NO: 31503 - DNA, 16 bp, Artificial Sequence
  synthetic [barcode part1]
tcgagtagtggcagac

SEQ ID NO: 31504 - DNA, 16 bp, Artificial Sequence
  synthetic [barcode part1]
agtcaacgactggttc

SEQ ID NO: 31505 - DNA, 16 bp, Artificial Sequence
  synthetic [barcode part1]
tacagataggcagtgt

SEQ ID NO: 31506 - DNA, 16 bp, Artificial Sequence
  synthetic [barcode part1]
ttagtattgcgtggcg

SEQ ID NO: 31507 - DNA, 16 bp, Artificial Sequence
  synthetic [barcode part1]
ttgactcacctctcgt

SEQ ID NO: 31508 - DNA, 16 bp, Artificial Sequence
  synthetic [barcode part1]
tgattgccttggtccg

SEQ ID NO: 31509 - DNA, 16 bp, Artificial Sequence
  synthetic [barcode part1]
ttggacgagtagagtt

SEQ ID NO: 31510 - DNA, 16 bp, Artificial Sequence
  synthetic [barcode part1]
attaggcactcctgcc

SEQ ID NO: 31511 - DNA, 16 bp, Artificial Sequence
  synthetic [barcode part1]
agattcctcggtcaag

SEQ ID NO: 31512 - DNA, 16 bp, Artificial Sequence
  synthetic [barcode part1]
ttctgattctcgccac

SEQ ID NO: 31513 - DNA, 16 bp, Artificial Sequence
  synthetic [barcode part1]
tcaggttccaagtcag

SEQ ID NO: 31514 - DNA, 16 bp, Artificial Sequence
  synthetic [barcode part1]
gacctccgtgtgactt

SEQ ID NO: 31515 - DNA, 16 bp, Artificial Sequence
  synthetic [barcode part1]
tacctaccgttcgtct

SEQ ID NO: 31516 - DNA, 16 bp, Artificial Sequence
  synthetic [barcode part1]
tacggatcaaggcgac

SEQ ID NO: 31517 - DNA, 16 bp, Artificial Sequence
  synthetic [barcode part1]
caatcgagatctcgac

SEQ ID NO: 31518 - DNA, 16 bp, Artificial Sequence
  synthetic [barcode part1]
cggttcctgcgtgatt

SEQ ID NO: 31519 - DNA, 16 bp, Artificial Sequence
  synthetic [barcode part1]
taccagtaattcctcg

SEQ ID NO: 31520 - DNA, 16 bp, Artificial Sequence
  synthetic [barcode part1]
atatagtgcacaccgc

SEQ ID NO: 31521 - DNA, 16 bp, Artificial Sequence
  synthetic [barcode part1]
gtaacctgcgatctag

SEQ ID NO: 31522 - DNA, 16 bp, Artificial Sequence
  synthetic [barcode part1]
accgcggttgtctgtt

SEQ ID NO: 31523 - DNA, 16 bp, Artificial Sequence
  synthetic [barcode part1]
acgtcctgaccactac

SEQ ID NO: 31524 - DNA, 16 bp, Artificial Sequence
  synthetic [barcode part1]
cagtggtgatcactgt

SEQ ID NO: 31525 - DNA, 16 bp, Artificial Sequence
  synthetic [barcode part1]
taataactccttgcgc

SEQ ID NO: 31526 - DNA, 16 bp, Artificial Sequence
  synthetic [barcode part1]
tgcggtattactcact

SEQ ID NO: 31527 - DNA, 16 bp, Artificial Sequence
  synthetic [barcode part1]
aacaagtctcaaggtg

SEQ ID NO: 31528 - DNA, 16 bp, Artificial Sequence
  synthetic [barcode part1]
caaggacttcgtactg

SEQ ID NO: 31529 - DNA, 16 bp, Artificial Sequence
  synthetic [barcode part1]
cgtctaatctcgttag

SEQ ID NO: 31530 - DNA, 16 bp, Artificial Sequence
  synthetic [barcode part1]
cctcttcggaatctct

SEQ ID NO: 31531 - DNA, 16 bp, Artificial Sequence
  synthetic [barcode part1]
aatccactaggacaag

SEQ ID NO: 31532 - DNA, 16 bp, Artificial Sequence
  synthetic [barcode part1]
gttacttccgtgaatc

SEQ ID NO: 31533 - DNA, 16 bp, Artificial Sequence
  synthetic [barcode part1]
taccagaagtgacctc

SEQ ID NO: 31534 - DNA, 16 bp, Artificial Sequence
  synthetic [barcode part1]
tgcagttaactgtgcg

SEQ ID NO: 31535 - DNA, 16 bp, Artificial Sequence
  synthetic [barcode part1]
ttcagttcgtgtagtc

SEQ ID NO: 31536 - DNA, 16 bp, Artificial Sequence
  synthetic [barcode part1]
aggttcaccaccgttc

SEQ ID NO: 31537 - DNA, 16 bp, Artificial Sequence
  synthetic [barcode part1]
accttacgtccgaatt

SEQ ID NO: 31538 - DNA, 16 bp, Artificial Sequence
  synthetic [barcode part1]
agactcttcaaccgag

SEQ ID NO: 31539 - DNA, 16 bp, Artificial Sequence
  synthetic [barcode part1]
ccagacctagtaactg

SEQ ID NO: 31540 - DNA, 16 bp, Artificial Sequence
  synthetic [barcode part1]
gcaagacagtgaagtg

SEQ ID NO: 31541 - DNA, 16 bp, Artificial Sequence
  synthetic [barcode part1]
tgttaccgcagaacgt

SEQ ID NO: 31542 - DNA, 16 bp, Artificial Sequence
  synthetic [barcode part1]
aggtctacgaactcac

SEQ ID NO: 31543 - DNA, 16 bp, Artificial Sequence
  synthetic [barcode part1]
gattaccgcgagaacg

SEQ ID NO: 31544 - DNA, 16 bp, Artificial Sequence
  synthetic [barcode part1]
tcttgagttacggcag

SEQ ID NO: 31545 - DNA, 16 bp, Artificial Sequence
  synthetic [barcode part1]
tcttctctctctctcc

SEQ ID NO: 31546 - DNA, 16 bp, Artificial Sequence
  synthetic [barcode part1]
aatcggcgttgcaact

SEQ ID NO: 31547 - DNA, 16 bp, Artificial Sequence
  synthetic [barcode part1]
taccttatctaggtgc

SEQ ID NO: 31548 - DNA, 16 bp, Artificial Sequence
  synthetic [barcode part1]
tcgaactctggatcag

SEQ ID NO: 31549 - DNA, 16 bp, Artificial Sequence
  synthetic [barcode part1]
gaacgtgttgacgacg

SEQ ID NO: 31550 - DNA, 16 bp, Artificial Sequence
  synthetic [barcode part1]
gtgagagtcaatagtc

SEQ ID NO: 31551 - DNA, 16 bp, Artificial Sequence
  synthetic [barcode part1]
gtgacgtacgtacgtt

SEQ ID NO: 31552 - DNA, 16 bp, Artificial Sequence
  synthetic [barcode part1]
gaagacaggtagttct

SEQ ID NO: 31553 - DNA, 16 bp, Artificial Sequence
  synthetic [barcode part1]
aagttcgcactggtac

SEQ ID NO: 31554 - DNA, 16 bp, Artificial Sequence
  synthetic [barcode part1]
ccttgacgactcgtac

SEQ ID NO: 31555 - DNA, 16 bp, Artificial Sequence
  synthetic [barcode part1]
cacttccttgagttag

SEQ ID NO: 31556 - DNA, 16 bp, Artificial Sequence
  synthetic [barcode part1]
aacctgagtgtagaac

SEQ ID NO: 31557 - DNA, 16 bp, Artificial Sequence
  synthetic [barcode part1]
tgatctcgtgcaccgt

SEQ ID NO: 31558 - DNA, 16 bp, Artificial Sequence
  synthetic [barcode part1]
gccagattctgcacct

SEQ ID NO: 31559 - DNA, 16 bp, Artificial Sequence
  synthetic [barcode part1]
tgaaccttcgtaggtg

SEQ ID NO: 31560 - DNA, 16 bp, Artificial Sequence
  synthetic [barcode part1]
ttataggcaccgacgt

SEQ ID NO: 31561 - DNA, 16 bp, Artificial Sequence
  synthetic [barcode part1]
cggatacgagaattgt

SEQ ID NO: 31562 - DNA, 16 bp, Artificial Sequence
  synthetic [barcode part1]
agttgtgagaactgac

SEQ ID NO: 31563 - DNA, 16 bp, Artificial Sequence
  synthetic [barcode part1]
tagatccacggattcg

SEQ ID NO: 31564 - DNA, 16 bp, Artificial Sequence
  synthetic [barcode part1]
ccaagactccgttcgt

SEQ ID NO: 31565 - DNA, 16 bp, Artificial Sequence
  synthetic [barcode part1]
ttaggtggtcttactc

SEQ ID NO: 31566 - DNA, 16 bp, Artificial Sequence
  synthetic [barcode part1]
ataggtcttcctgatc

SEQ ID NO: 31567 - DNA, 16 bp, Artificial Sequence
  synthetic [barcode part1]
ccacgttggactactc

SEQ ID NO: 31568 - DNA, 16 bp, Artificial Sequence
  synthetic [barcode part1]
taccacactaggactg

SEQ ID NO: 31569 - DNA, 16 bp, Artificial Sequence
  synthetic [barcode part1]
acaccgacggttctct

SEQ ID NO: 31570 - DNA, 16 bp, Artificial Sequence
  synthetic [barcode part1]
ttacttgacctgcctc

SEQ ID NO: 31571 - DNA, 16 bp, Artificial Sequence
  synthetic [barcode part1]
aaggatagacggcctc

SEQ ID NO: 31572 - DNA, 16 bp, Artificial Sequence
  synthetic [barcode part1]
ttggttggccgattag

SEQ ID NO: 31573 - DNA, 16 bp, Artificial Sequence
  synthetic [barcode part1]
tagattactccgtacc

SEQ ID NO: 31574 - DNA, 16 bp, Artificial Sequence
  synthetic [barcode part1]
cggaacaagtatactg

SEQ ID NO: 31575 - DNA, 16 bp, Artificial Sequence
  synthetic [barcode part1]
ttccgactagtaggac

SEQ ID NO: 31576 - DNA, 16 bp, Artificial Sequence
  synthetic [barcode part1]
tggtgccaatattgcg

SEQ ID NO: 31577 - DNA, 16 bp, Artificial Sequence
  synthetic [barcode part1]
tgacaacgatcgtcac

SEQ ID NO: 31578 - DNA, 16 bp, Artificial Sequence
  synthetic [barcode part1]
actctaggacttcgag

SEQ ID NO: 31579 - DNA, 16 bp, Artificial Sequence
  synthetic [barcode part1]
tccaccgatacttagt

SEQ ID NO: 31580 - DNA, 16 bp, Artificial Sequence
  synthetic [barcode part1]
gcacaccacagagtag

SEQ ID NO: 31581 - DNA, 16 bp, Artificial Sequence
  synthetic [barcode part1]
gactgtgacacactgt

SEQ ID NO: 31582 - DNA, 16 bp, Artificial Sequence
  synthetic [barcode part1]
tctagttcacgaccgc

SEQ ID NO: 31583 - DNA, 16 bp, Artificial Sequence
  synthetic [barcode part1]
acggcacaatcctaac

SEQ ID NO: 31584 - DNA, 16 bp, Artificial Sequence
  synthetic [barcode part1]
ccaactagtcgtaacg

SEQ ID NO: 31585 - DNA, 16 bp, Artificial Sequence
  synthetic [barcode part1]
gtgtcaagtcgtctcc

SEQ ID NO: 31586 - DNA, 16 bp, Artificial Sequence
  synthetic [barcode part1]
tgactgacgtacacac

SEQ ID NO: 31587 - DNA, 16 bp, Artificial Sequence
  synthetic [barcode part1]
ccaactatctccttcg

SEQ ID NO: 31588 - DNA, 16 bp, Artificial Sequence
  synthetic [barcode part1]
actaacgagtgcactc

SEQ ID NO: 31589 - DNA, 16 bp, Artificial Sequence
  synthetic [barcode part1]
ttacctgcgtccactt

SEQ ID NO: 31590 - DNA, 16 bp, Artificial Sequence
  synthetic [barcode part1]
atctatcgcctcaggc

SEQ ID NO: 31591 - DNA, 16 bp, Artificial Sequence
  synthetic [barcode part1]
atcacggatccgtcct

SEQ ID NO: 31592 - DNA, 16 bp, Artificial Sequence
  synthetic [barcode part1]
tctccacgaactattg

SEQ ID NO: 31593 - DNA, 16 bp, Artificial Sequence
  synthetic [barcode part1]
agtcgtgccttaatct

SEQ ID NO: 31594 - DNA, 16 bp, Artificial Sequence
  synthetic [barcode part1]
gagtccaacctcctgt

SEQ ID NO: 31595 - DNA, 16 bp, Artificial Sequence
  synthetic [barcode part1]
aatctggccgacaatc

SEQ ID NO: 31596 - DNA, 16 bp, Artificial Sequence
  synthetic [barcode part1]
aggatcttatccactc

SEQ ID NO: 31597 - DNA, 16 bp, Artificial Sequence
  synthetic [barcode part1]
agaactcttcgtctac

SEQ ID NO: 31598 - DNA, 16 bp, Artificial Sequence
  synthetic [barcode part1]
cagtccggagttattg

SEQ ID NO: 31599 - DNA, 16 bp, Artificial Sequence
  synthetic [barcode part1]
gcaggccaagataatt

SEQ ID NO: 31600 - DNA, 16 bp, Artificial Sequence
  synthetic [barcode part1]
tatcagagtgaggact

SEQ ID NO: 31601 - DNA, 16 bp, Artificial Sequence
  synthetic [barcode part1]
gtgtctaacttcgccg

SEQ ID NO: 31602 - DNA, 16 bp, Artificial Sequence
  synthetic [barcode part1]
gacgcaccttcttgac

SEQ ID NO: 31603 - DNA, 16 bp, Artificial Sequence
  synthetic [barcode part1]
agaggcgatctgacgt

SEQ ID NO: 31604 - DNA, 16 bp, Artificial Sequence
  synthetic [barcode part1]
cgtggatctatcttgt

SEQ ID NO: 31605 - DNA, 16 bp, Artificial Sequence
  synthetic [barcode part1]
gaactcactgttgttc

SEQ ID NO: 31606 - DNA, 16 bp, Artificial Sequence
  synthetic [barcode part1]
ttctaggtctatccag

SEQ ID NO: 31607 - DNA, 16 bp, Artificial Sequence
  synthetic [barcode part1]
tggagaggtcggtatc

SEQ ID NO: 31608 - DNA, 16 bp, Artificial Sequence
  synthetic [barcode part1]
cgcggtgtaagtgagt

SEQ ID NO: 31609 - DNA, 16 bp, Artificial Sequence
  synthetic [barcode part1]
aacgtcagtgttgcac

SEQ ID NO: 31610 - DNA, 16 bp, Artificial Sequence
  synthetic [barcode part1]
acaccagaaggcgact

SEQ ID NO: 31611 - DNA, 16 bp, Artificial Sequence
  synthetic [barcode part1]
gagatctgcggtattc

SEQ ID NO: 31612 - DNA, 16 bp, Artificial Sequence
  synthetic [barcode part1]
tacgcctgagtcgttc

SEQ ID NO: 31613 - DNA, 16 bp, Artificial Sequence
  synthetic [barcode part1]
gaacagataggcgagt

SEQ ID NO: 31614 - DNA, 16 bp, Artificial Sequence
  synthetic [barcode part1]
tgacaggcgagataag

SEQ ID NO: 31615 - DNA, 16 bp, Artificial Sequence
  synthetic [barcode part1]
tcagttgtgcaacacg

SEQ ID NO: 31616 - DNA, 16 bp, Artificial Sequence
  synthetic [barcode part1]
tcgcgacactaatcag

SEQ ID NO: 31617 - DNA, 16 bp, Artificial Sequence
  synthetic [barcode part1]
tacacggacctctcgt

SEQ ID NO: 31618 - DNA, 16 bp, Artificial Sequence
  synthetic [barcode part1]
gcagttatcggtcctc

SEQ ID NO: 31619 - DNA, 16 bp, Artificial Sequence
  synthetic [barcode part1]
caggagacttcaatcc

SEQ ID NO: 31620 - DNA, 16 bp, Artificial Sequence
  synthetic [barcode part1]
cgtatctggtagttct

SEQ ID NO: 31621 - DNA, 16 bp, Artificial Sequence
  synthetic [barcode part1]
cgatctccgtgattgc

SEQ ID NO: 31622 - DNA, 16 bp, Artificial Sequence
  synthetic [barcode part1]
tctagactggatccag

SEQ ID NO: 31623 - DNA, 16 bp, Artificial Sequence
  synthetic [barcode part1]
tacggcacaggtgagt

SEQ ID NO: 31624 - DNA, 16 bp, Artificial Sequence
  synthetic [barcode part1]
tgacaacagtctggtc

SEQ ID NO: 31625 - DNA, 16 bp, Artificial Sequence
  synthetic [barcode part1]
gcaccagatacaactc

SEQ ID NO: 31626 - DNA, 16 bp, Artificial Sequence
  synthetic [barcode part1]
acgtcgcaatagatag

SEQ ID NO: 31627 - DNA, 16 bp, Artificial Sequence
  synthetic [barcode part1]
gtcttcctctcgattg

SEQ ID NO: 31628 - DNA, 16 bp, Artificial Sequence
  synthetic [barcode part1]
cgtcctgttgtaagtt

SEQ ID NO: 31629 - DNA, 16 bp, Artificial Sequence
  synthetic [barcode part1]
ttcttgtcaagtcgtg

SEQ ID NO: 31630 - DNA, 16 bp, Artificial Sequence
  synthetic [barcode part1]
gtggactaacctgtgt

SEQ ID NO: 31631 - DNA, 16 bp, Artificial Sequence
  synthetic [barcode part1]
cgaccaattaaggcct

SEQ ID NO: 31632 - DNA, 16 bp, Artificial Sequence
  synthetic [barcode part1]
caccgttgtaaccacc

SEQ ID NO: 31633 - DNA, 16 bp, Artificial Sequence
  synthetic [barcode part1]
accaacgcgaagaatt

SEQ ID NO: 31634 - DNA, 16 bp, Artificial Sequence
  synthetic [barcode part1]
caggttaatacaggac

SEQ ID NO: 31635 - DNA, 16 bp, Artificial Sequence
  synthetic [barcode part1]
gcactagagaacagtt

SEQ ID NO: 31636 - DNA, 16 bp, Artificial Sequence
  synthetic [barcode part1]
aacgcgaatagtctag

SEQ ID NO: 31637 - DNA, 16 bp, Artificial Sequence
  synthetic [barcode part1]
taattgtccaccgttg

SEQ ID NO: 31638 - DNA, 16 bp, Artificial Sequence
  synthetic [barcode part1]
tgtgactctcctgacg

SEQ ID NO: 31639 - DNA, 16 bp, Artificial Sequence
  synthetic [barcode part1]
gattcctcgactcctt

SEQ ID NO: 31640 - DNA, 16 bp, Artificial Sequence
  synthetic [barcode part1]
gtggtacgactctagt

SEQ ID NO: 31641 - DNA, 16 bp, Artificial Sequence
  synthetic [barcode part1]
gtagactcaacttctc

SEQ ID NO: 31642 - DNA, 16 bp, Artificial Sequence
  synthetic [barcode part1]
tgagtatacgcctggt

SEQ ID NO: 31643 - DNA, 16 bp, Artificial Sequence
  synthetic [barcode part1]
gcaattctactaggcg

SEQ ID NO: 31644 - DNA, 16 bp, Artificial Sequence
  synthetic [barcode part1]
caggtcacgtactcct

SEQ ID NO: 31645 - DNA, 16 bp, Artificial Sequence
  synthetic [barcode part1]
acgttaaggaggccgt

SEQ ID NO: 31646 - DNA, 16 bp, Artificial Sequence
  synthetic [barcode part1]
atagacaccacagtag

SEQ ID NO: 31647 - DNA, 16 bp, Artificial Sequence
  synthetic [barcode part1]
cactcacaacaagtgc

SEQ ID NO: 31648 - DNA, 16 bp, Artificial Sequence
  synthetic [barcode part1]
tggatcagattcggtc

SEQ ID NO: 31649 - DNA, 16 bp, Artificial Sequence
  synthetic [barcode part1]
acgaggttgttatccg

SEQ ID NO: 31650 - DNA, 16 bp, Artificial Sequence
  synthetic [barcode part1]
ccttggtagtctatac

SEQ ID NO: 31651 - DNA, 16 bp, Artificial Sequence
  synthetic [barcode part1]
cagtagtccttgtatc

SEQ ID NO: 31652 - DNA, 16 bp, Artificial Sequence
  synthetic [barcode part1]
cgtcactggtgtgttc

SEQ ID NO: 31653 - DNA, 16 bp, Artificial Sequence
  synthetic [barcode part1]
gcaaggaagttcaatc

SEQ ID NO: 31654 - DNA, 16 bp, Artificial Sequence
  synthetic [barcode part1]
gatcaacaaccggttc

SEQ ID NO: 31655 - DNA, 16 bp, Artificial Sequence
  synthetic [barcode part1]
tagtcagtcagtcgac

SEQ ID NO: 31656 - DNA, 16 bp, Artificial Sequence
  synthetic [barcode part1]
gcactggtctccaatc

SEQ ID NO: 31657 - DNA, 16 bp, Artificial Sequence
  synthetic [barcode part1]
aggacttggatagatc

SEQ ID NO: 31658 - DNA, 16 bp, Artificial Sequence
  synthetic [barcode part1]
cgccttgaacaggatt

SEQ ID NO: 31659 - DNA, 16 bp, Artificial Sequence
  synthetic [barcode part1]
ccagtgcaacttcctg

SEQ ID NO: 31660 - DNA, 16 bp, Artificial Sequence
  synthetic [barcode part1]
gatcttggcaggtgag

SEQ ID NO: 31661 - DNA, 16 bp, Artificial Sequence
  synthetic [barcode part1]
tacgtgttcttcctcg

SEQ ID NO: 31662 - DNA, 16 bp, Artificial Sequence
  synthetic [barcode part1]
ccttaaggtggacgag

SEQ ID NO: 31663 - DNA, 16 bp, Artificial Sequence
  synthetic [barcode part1]
gttccacaggtgttcc

SEQ ID NO: 31664 - DNA, 16 bp, Artificial Sequence
  synthetic [barcode part1]
tgtgtaatcaccacct

SEQ ID NO: 31665 - DNA, 16 bp, Artificial Sequence
  synthetic [barcode part1]
gtgtaacactacacgc

SEQ ID NO: 31666 - DNA, 16 bp, Artificial Sequence
  synthetic [barcode part1]
ataacgcgtcgtgatc

SEQ ID NO: 31667 - DNA, 16 bp, Artificial Sequence
  synthetic [barcode part1]
ataccgaatcagagac

SEQ ID NO: 31668 - DNA, 16 bp, Artificial Sequence
  synthetic [barcode part1]
acttaccggacaggtt

SEQ ID NO: 31669 - DNA, 16 bp, Artificial Sequence
  synthetic [barcode part1]
actgacactatacggc

SEQ ID NO: 31670 - DNA, 16 bp, Artificial Sequence
  synthetic [barcode part1]
attccgagagaccttg

SEQ ID NO: 31671 - DNA, 16 bp, Artificial Sequence
  synthetic [barcode part1]
gcagattgtgcgattc

SEQ ID NO: 31672 - DNA, 16 bp, Artificial Sequence
  synthetic [barcode part1]
ttcctcgatcttccag

SEQ ID NO: 31673 - DNA, 16 bp, Artificial Sequence
  synthetic [barcode part1]
atcctgaacgtgtacg

SEQ ID NO: 31674 - DNA, 16 bp, Artificial Sequence
  synthetic [barcode part1]
gactacgtgcaatcgt

SEQ ID NO: 31675 - DNA, 16 bp, Artificial Sequence
  synthetic [barcode part1]
cgtggaacgacgattg

SEQ ID NO: 31676 - DNA, 16 bp, Artificial Sequence
  synthetic [barcode part1]
cacacagaggtgtctt

SEQ ID NO: 31677 - DNA, 16 bp, Artificial Sequence
  synthetic [barcode part1]
gactgtgtgcaactgt

SEQ ID NO: 31678 - DNA, 16 bp, Artificial Sequence
  synthetic [barcode part1]
gcctctggaatacagt

SEQ ID NO: 31679 - DNA, 16 bp, Artificial Sequence
  synthetic [barcode part1]
acagtgtggagagaac

SEQ ID NO: 31680 - DNA, 16 bp, Artificial Sequence
  synthetic [barcode part1]
gcacagtacacgttgt

SEQ ID NO: 31681 - DNA, 16 bp, Artificial Sequence
  synthetic [barcode part1]
tgaggttggttctgac

SEQ ID NO: 31682 - DNA, 16 bp, Artificial Sequence
  synthetic [barcode part1]
gcgagtagataggtag

SEQ ID NO: 31683 - DNA, 16 bp, Artificial Sequence
  synthetic [barcode part1]
ccacgagagtaacgac

SEQ ID NO: 31684 - DNA, 16 bp, Artificial Sequence
  synthetic [barcode part1]
tagtgtcacggtgttg

SEQ ID NO: 31685 - DNA, 16 bp, Artificial Sequence
  synthetic [barcode part1]
tccacacggttcgatc

SEQ ID NO: 31686 - DNA, 16 bp, Artificial Sequence
  synthetic [barcode part1]
tcaacttgtccttcgc

SEQ ID NO: 31687 - DNA, 16 bp, Artificial Sequence
  synthetic [barcode part1]
tggcaacgatccgatt

SEQ ID NO: 31688 - DNA, 16 bp, Artificial Sequence
  synthetic [barcode part1]
cgatacgaccaggagt

SEQ ID NO: 31689 - DNA, 16 bp, Artificial Sequence
  synthetic [barcode part1]
ataccaagttggaggt

SEQ ID NO: 31690 - DNA, 16 bp, Artificial Sequence
  synthetic [barcode part1]
gagacaccagtagtcg

SEQ ID NO: 31691 - DNA, 16 bp, Artificial Sequence
  synthetic [barcode part1]
attataaggcggacgt

SEQ ID NO: 31692 - DNA, 16 bp, Artificial Sequence
  synthetic [barcode part1]
tgcaacgacgagtggt

SEQ ID NO: 31693 - DNA, 16 bp, Artificial Sequence
  synthetic [barcode part1]
acaggcacaggacttg

SEQ ID NO: 31694 - DNA, 16 bp, Artificial Sequence
  synthetic [barcode part1]
cgtgagtacttgtggt

SEQ ID NO: 31695 - DNA, 16 bp, Artificial Sequence
  synthetic [barcode part1]
caacgacgagacgtgt

SEQ ID NO: 31696 - DNA, 16 bp, Artificial Sequence
  synthetic [barcode part1]
acggttgcgattgtgt

SEQ ID NO: 31697 - DNA, 16 bp, Artificial Sequence
  synthetic [barcode part1]
tcaagtcctagaccag

SEQ ID NO: 31698 - DNA, 16 bp, Artificial Sequence
  synthetic [barcode part1]
gatcacactccaattc

SEQ ID NO: 31699 - DNA, 16 bp, Artificial Sequence
  synthetic [barcode part1]
tggtacttgagtagag

SEQ ID NO: 31700 - DNA, 16 bp, Artificial Sequence
  synthetic [barcode part1]
gattgcaggagtcgac

SEQ ID NO: 31701 - DNA, 16 bp, Artificial Sequence
  synthetic [barcode part1]
atccaagataacggac

SEQ ID NO: 31702 - DNA, 16 bp, Artificial Sequence
  synthetic [barcode part1]
gagtctgtcaccgtct

SEQ ID NO: 31703 - DNA, 16 bp, Artificial Sequence
  synthetic [barcode part1]
atccactctcaggatt

SEQ ID NO: 31704 - DNA, 16 bp, Artificial Sequence
  synthetic [barcode part1]
taggttcggtggagtg

SEQ ID NO: 31705 - DNA, 16 bp, Artificial Sequence
  synthetic [barcode part1]
taagtcctggagtaag

SEQ ID NO: 31706 - DNA, 16 bp, Artificial Sequence
  synthetic [barcode part1]
gttatctctgcagatc

SEQ ID NO: 31707 - DNA, 16 bp, Artificial Sequence
  synthetic [barcode part1]
cgcgtgaacttaagtc

SEQ ID NO: 31708 - DNA, 16 bp, Artificial Sequence
  synthetic [barcode part1]
gagtcgtacctccgtt

SEQ ID NO: 31709 - DNA, 16 bp, Artificial Sequence
  synthetic [barcode part1]
gactacagtgcactac

SEQ ID NO: 31710 - DNA, 16 bp, Artificial Sequence
  synthetic [barcode part1]
gttcctgtgagttgcc

SEQ ID NO: 31711 - DNA, 16 bp, Artificial Sequence
  synthetic [barcode part1]
ttctgagacgagtaag

SEQ ID NO: 31712 - DNA, 16 bp, Artificial Sequence
  synthetic [barcode part1]
gttcaacgaggacgtg

SEQ ID NO: 31713 - DNA, 16 bp, Artificial Sequence
  synthetic [barcode part1]
agagtccgagtagatt

SEQ ID NO: 31714 - DNA, 16 bp, Artificial Sequence
  synthetic [barcode part1]
caacctcgtcaatatc

SEQ ID NO: 31715 - DNA, 16 bp, Artificial Sequence
  synthetic [barcode part1]
cacggtacctgagatt

SEQ ID NO: 31716 - DNA, 16 bp, Artificial Sequence
  synthetic [barcode part1]
gagttctggagagaag

SEQ ID NO: 31717 - DNA, 16 bp, Artificial Sequence
  synthetic [barcode part1]
caagaagacgcaccgt

SEQ ID NO: 31718 - DNA, 16 bp, Artificial Sequence
  synthetic [barcode part1]
agacttctaaccgacg

SEQ ID NO: 31719 - DNA, 16 bp, Artificial Sequence
  synthetic [barcode part1]
ccaacctgtaactgcc

SEQ ID NO: 31720 - DNA, 16 bp, Artificial Sequence
  synthetic [barcode part1]
gacggtatctatcacg

SEQ ID NO: 31721 - DNA, 16 bp, Artificial Sequence
  synthetic [barcode part1]
gttggtattcacggac

SEQ ID NO: 31722 - DNA, 16 bp, Artificial Sequence
  synthetic [barcode part1]
atcctgaccaactgag

SEQ ID NO: 31723 - DNA, 16 bp, Artificial Sequence
  synthetic [barcode part1]
cgaattgagagacgcc

SEQ ID NO: 31724 - DNA, 16 bp, Artificial Sequence
  synthetic [barcode part1]
tagagtacggattcag

SEQ ID NO: 31725 - DNA, 16 bp, Artificial Sequence
  synthetic [barcode part1]
gcaatacctctgagac

SEQ ID NO: 31726 - DNA, 16 bp, Artificial Sequence
  synthetic [barcode part1]
gttgtcttccaagtgt

SEQ ID NO: 31727 - DNA, 16 bp, Artificial Sequence
  synthetic [barcode part1]
cgccactgttcgagtt

SEQ ID NO: 31728 - DNA, 16 bp, Artificial Sequence
  synthetic [barcode part1]
gttcagactgcaagtc

SEQ ID NO: 31729 - DNA, 16 bp, Artificial Sequence
  synthetic [barcode part1]
acaacgttgtgtgtgc

SEQ ID NO: 31730 - DNA, 16 bp, Artificial Sequence
  synthetic [barcode part1]
tctgtgtaacctgact

SEQ ID NO: 31731 - DNA, 16 bp, Artificial Sequence
  synthetic [barcode part1]
aggcgatacacttaag

SEQ ID NO: 31732 - DNA, 16 bp, Artificial Sequence
  synthetic [barcode part1]
acgttagtcaagtgcc

SEQ ID NO: 31733 - DNA, 16 bp, Artificial Sequence
  synthetic [barcode part1]
cctcacagatctaatc

SEQ ID NO: 31734 - DNA, 16 bp, Artificial Sequence
  synthetic [barcode part1]
cctcctatccaatctg

SEQ ID NO: 31735 - DNA, 16 bp, Artificial Sequence
  synthetic [barcode part1]
tgtgttggttggtacg

SEQ ID NO: 31736 - DNA, 16 bp, Artificial Sequence
  synthetic [barcode part1]
agtcaattggccgact

SEQ ID NO: 31737 - DNA, 16 bp, Artificial Sequence
  synthetic [barcode part1]
tccactgcagtagaac

SEQ ID NO: 31738 - DNA, 16 bp, Artificial Sequence
  synthetic [barcode part1]
tatcaggtcaccgaac

SEQ ID NO: 31739 - DNA, 16 bp, Artificial Sequence
  synthetic [barcode part1]
tgtacgattcacaggc

SEQ ID NO: 31740 - DNA, 16 bp, Artificial Sequence
  synthetic [barcode part1]
gtggaagtacaggaac

SEQ ID NO: 31741 - DNA, 16 bp, Artificial Sequence
  synthetic [barcode part1]
ccaccagtaacaactg

SEQ ID NO: 31742 - DNA, 16 bp, Artificial Sequence
  synthetic [barcode part1]
agatagtaactcgcag

SEQ ID NO: 31743 - DNA, 16 bp, Artificial Sequence
  synthetic [barcode part1]
tccgccgaattacacc

SEQ ID NO: 31744 - DNA, 16 bp, Artificial Sequence
  synthetic [barcode part1]
actctgatcgagatcg

SEQ ID NO: 31745 - DNA, 16 bp, Artificial Sequence
  synthetic [barcode part1]
gtataattcttccggc

SEQ ID NO: 31746 - DNA, 16 bp, Artificial Sequence
  synthetic [barcode part1]
tgattctgtgtaccac

SEQ ID NO: 31747 - DNA, 16 bp, Artificial Sequence
  synthetic [barcode part1]
acctgcgaatctgtag

SEQ ID NO: 31748 - DNA, 16 bp, Artificial Sequence
  synthetic [barcode part1]
gatcagtagaacctcc

SEQ ID NO: 31749 - DNA, 16 bp, Artificial Sequence
  synthetic [barcode part1]
gacaactaccgaactc

SEQ ID NO: 31750 - DNA, 16 bp, Artificial Sequence
  synthetic [barcode part1]
agttcggtctctgcgt

SEQ ID NO: 31751 - DNA, 16 bp, Artificial Sequence
  synthetic [barcode part1]
ttcacagttcaggcag

SEQ ID NO: 31752 - DNA, 16 bp, Artificial Sequence
  synthetic [barcode part1]
agtaagacagtcctcc

SEQ ID NO: 31753 - DNA, 16 bp, Artificial Sequence
  synthetic [barcode part1]
accgaagtcaacttcg

SEQ ID NO: 31754 - DNA, 16 bp, Artificial Sequence
  synthetic [barcode part1]
tggacttattccgccg

SEQ ID NO: 31755 - DNA, 16 bp, Artificial Sequence
  synthetic [barcode part1]
gaggtgatctactacc

SEQ ID NO: 31756 - DNA, 16 bp, Artificial Sequence
  synthetic [barcode part1]
actctacgcgaccgtt

SEQ ID NO: 31757 - DNA, 16 bp, Artificial Sequence
  synthetic [barcode part1]
gcgtagttacagtcgt

SEQ ID NO: 31758 - DNA, 16 bp, Artificial Sequence
  synthetic [barcode part1]
tcgcgtcaggttgtct

SEQ ID NO: 31759 - DNA, 16 bp, Artificial Sequence
  synthetic [barcode part1]
ttcgattaccgacgcc

SEQ ID NO: 31760 - DNA, 16 bp, Artificial Sequence
  synthetic [barcode part1]
tggaataacttaggcg

SEQ ID NO: 31761 - DNA, 16 bp, Artificial Sequence
  synthetic [barcode part1]
agaaccttccagagtc

SEQ ID NO: 31762 - DNA, 16 bp, Artificial Sequence
  synthetic [barcode part1]
gtatcctccgagtcgt

SEQ ID NO: 31763 - DNA, 16 bp, Artificial Sequence
  synthetic [barcode part1]
cggaaccaattccaac

SEQ ID NO: 31764 - DNA, 16 bp, Artificial Sequence
  synthetic [barcode part1]
ccagttcacaaggtac

SEQ ID NO: 31765 - DNA, 16 bp, Artificial Sequence
  synthetic [barcode part1]
gaaggtggtaatccgc

SEQ ID NO: 31766 - DNA, 16 bp, Artificial Sequence
  synthetic [barcode part1]
tactgtgactgtggtg

SEQ ID NO: 31767 - DNA, 16 bp, Artificial Sequence
  synthetic [barcode part1]
tcagtccagtgacaac

SEQ ID NO: 31768 - DNA, 16 bp, Artificial Sequence
  synthetic [barcode part1]
aacgtctatccaggtg

SEQ ID NO: 31769 - DNA, 16 bp, Artificial Sequence
  synthetic [barcode part1]
actagaaccaacctcg

SEQ ID NO: 31770 - DNA, 16 bp, Artificial Sequence
  synthetic [barcode part1]
tagatcgacactcttc

SEQ ID NO: 31771 - DNA, 16 bp, Artificial Sequence
  synthetic [barcode part1]
tcacaggtgaactcgt

SEQ ID NO: 31772 - DNA, 16 bp, Artificial Sequence
  synthetic [barcode part1]
agacaaggtcctaagt

SEQ ID NO: 31773 - DNA, 16 bp, Artificial Sequence
  synthetic [barcode part1]
atacagtcggcacact

SEQ ID NO: 31774 - DNA, 16 bp, Artificial Sequence
  synthetic [barcode part1]
tcggagagtgcaactg

SEQ ID NO: 31775 - DNA, 16 bp, Artificial Sequence
  synthetic [barcode part1]
acgaccacgatacgtt

SEQ ID NO: 31776 - DNA, 16 bp, Artificial Sequence
  synthetic [barcode part1]
gttgcgatccaggatt

SEQ ID NO: 31777 - DNA, 16 bp, Artificial Sequence
  synthetic [barcode part1]
gagagtcacgttggtg

SEQ ID NO: 31778 - DNA, 16 bp, Artificial Sequence
  synthetic [barcode part1]
gtcagagatcacgcag

SEQ ID NO: 31779 - DNA, 16 bp, Artificial Sequence
  synthetic [barcode part1]
ttcagacaacggtaag

SEQ ID NO: 31780 - DNA, 16 bp, Artificial Sequence
  synthetic [barcode part1]
tcgatagtagaccacc

SEQ ID NO: 31781 - DNA, 16 bp, Artificial Sequence
  synthetic [barcode part1]
attctggcgtgatacg

SEQ ID NO: 31782 - DNA, 16 bp, Artificial Sequence
  synthetic [barcode part1]
ttcacacctaggttgt

SEQ ID NO: 31783 - DNA, 16 bp, Artificial Sequence
  synthetic [barcode part1]
aacgacctacactctt

SEQ ID NO: 31784 - DNA, 16 bp, Artificial Sequence
  synthetic [barcode part1]
ccgattctactggcac

SEQ ID NO: 31785 - DNA, 16 bp, Artificial Sequence
  synthetic [barcode part1]
tatccgtacaggcagt

SEQ ID NO: 31786 - DNA, 16 bp, Artificial Sequence
  synthetic [barcode part1]
aacttcgcggaacttg

SEQ ID NO: 31787 - DNA, 16 bp, Artificial Sequence
  synthetic [barcode part1]
gagatccgttcgcctt

SEQ ID NO: 31788 - DNA, 16 bp, Artificial Sequence
  synthetic [barcode part1]
ccttgcaccaacgatc

SEQ ID NO: 31789 - DNA, 16 bp, Artificial Sequence
  synthetic [barcode part1]
cggcaacttctatatc

SEQ ID NO: 31790 - DNA, 16 bp, Artificial Sequence
  synthetic [barcode part1]
cggaccgatacaaggt

SEQ ID NO: 31791 - DNA, 16 bp, Artificial Sequence
  synthetic [barcode part1]
gcaacgtctaggatct

SEQ ID NO: 31792 - DNA, 16 bp, Artificial Sequence
  synthetic [barcode part1]
gcaaggacaatccgac

SEQ ID NO: 31793 - DNA, 16 bp, Artificial Sequence
  synthetic [barcode part1]
tcaactgtgaccagtg

SEQ ID NO: 31794 - DNA, 16 bp, Artificial Sequence
  synthetic [barcode part1]
ccttgtgaattaccac

SEQ ID NO: 31795 - DNA, 16 bp, Artificial Sequence
  synthetic [barcode part1]
accgatacctacgaac

SEQ ID NO: 31796 - DNA, 16 bp, Artificial Sequence
  synthetic [barcode part1]
cagtgcacacaagtct

SEQ ID NO: 31797 - DNA, 16 bp, Artificial Sequence
  synthetic [barcode part1]
gagttggcacagtcag

SEQ ID NO: 31798 - DNA, 16 bp, Artificial Sequence
  synthetic [barcode part1]
gattagtacgcgcact

SEQ ID NO: 31799 - DNA, 16 bp, Artificial Sequence
  synthetic [barcode part1]
cgtaacactacttacc

SEQ ID NO: 31800 - DNA, 16 bp, Artificial Sequence
  synthetic [barcode part1]
tggacgtgtgtctagt

SEQ ID NO: 31801 - DNA, 16 bp, Artificial Sequence
  synthetic [barcode part1]
gtgattcagaccgttg

SEQ ID NO: 31802 - DNA, 16 bp, Artificial Sequence
  synthetic [barcode part1]
acgcgtcttcaacctg

SEQ ID NO: 31803 - DNA, 16 bp, Artificial Sequence
  synthetic [barcode part1]
ttcaccaggccacgtt

SEQ ID NO: 31804 - DNA, 16 bp, Artificial Sequence
  synthetic [barcode part1]
gacaactccgaattgc

SEQ ID NO: 31805 - DNA, 16 bp, Artificial Sequence
  synthetic [barcode part1]
cagactgaagatacgt

SEQ ID NO: 31806 - DNA, 16 bp, Artificial Sequence
  synthetic [barcode part1]
cgtccttgattactag

SEQ ID NO: 31807 - DNA, 16 bp, Artificial Sequence
  synthetic [barcode part1]
aggtggacaccgtaac

SEQ ID NO: 31808 - DNA, 16 bp, Artificial Sequence
  synthetic [barcode part1]
tcttatcacttgcgag

SEQ ID NO: 31809 - DNA, 16 bp, Artificial Sequence
  synthetic [barcode part1]
atacggttgatcgcac

SEQ ID NO: 31810 - DNA, 16 bp, Artificial Sequence
  synthetic [barcode part1]
agactatagaccgcct

SEQ ID NO: 31811 - DNA, 16 bp, Artificial Sequence
  synthetic [barcode part1]
acggagttctatcacg

SEQ ID NO: 31812 - DNA, 16 bp, Artificial Sequence
  synthetic [barcode part1]
tgttgaccacacagtg

SEQ ID NO: 31813 - DNA, 16 bp, Artificial Sequence
  synthetic [barcode part1]
aacaccttaaggaacg

SEQ ID NO: 31814 - DNA, 16 bp, Artificial Sequence
  synthetic [barcode part1]
agacggatcacaatac

SEQ ID NO: 31815 - DNA, 16 bp, Artificial Sequence
  synthetic [barcode part1]
tggaggatcaaccttc

SEQ ID NO: 31816 - DNA, 16 bp, Artificial Sequence
  synthetic [barcode part1]
gtatcactgtcgcaag

SEQ ID NO: 31817 - DNA, 16 bp, Artificial Sequence
  synthetic [barcode part1]
attgttacacgtcctg

SEQ ID NO: 31818 - DNA, 16 bp, Artificial Sequence
  synthetic [barcode part1]
aaccagtcaacgtcac

SEQ ID NO: 31819 - DNA, 16 bp, Artificial Sequence
  synthetic [barcode part1]
tcaggacgtcttgagt

SEQ ID NO: 31820 - DNA, 16 bp, Artificial Sequence
  synthetic [barcode part1]
cgatactgtagtgtcg

SEQ ID NO: 31821 - DNA, 16 bp, Artificial Sequence
  synthetic [barcode part1]
agtggtgcgagtatcg

SEQ ID NO: 31822 - DNA, 16 bp, Artificial Sequence
  synthetic [barcode part1]
aatacttgtgaggcag

SEQ ID NO: 31823 - DNA, 16 bp, Artificial Sequence
  synthetic [barcode part1]
cgtcgttgtggttgtc

SEQ ID NO: 31824 - DNA, 16 bp, Artificial Sequence
  synthetic [barcode part1]
cgcacggtctgattct

SEQ ID NO: 31825 - DNA, 16 bp, Artificial Sequence
  synthetic [barcode part1]
gagttcttgtgacacg

SEQ ID NO: 31826 - DNA, 16 bp, Artificial Sequence
  synthetic [barcode part1]
ttgacggttcgtactt

SEQ ID NO: 31827 - DNA, 16 bp, Artificial Sequence
  synthetic [barcode part1]
ttctccttccttcctc

SEQ ID NO: 31828 - DNA, 16 bp, Artificial Sequence
  synthetic [barcode part1]
atcgcgactgtccgtt

SEQ ID NO: 31829 - DNA, 16 bp, Artificial Sequence
  synthetic [barcode part1]
gaaccaggagactaag

SEQ ID NO: 31830 - DNA, 16 bp, Artificial Sequence
  synthetic [barcode part1]
agtcaggtctgacttg

SEQ ID NO: 31831 - DNA, 16 bp, Artificial Sequence
  synthetic [barcode part1]
gtcgagtgtgaggact

SEQ ID NO: 31832 - DNA, 16 bp, Artificial Sequence
  synthetic [barcode part1]
taccgttaggcgtcct

SEQ ID NO: 31833 - DNA, 16 bp, Artificial Sequence
  synthetic [barcode part1]
gcctcgttcactactt

SEQ ID NO: 31834 - DNA, 16 bp, Artificial Sequence
  synthetic [barcode part1]
taacaatcttcgcacc

SEQ ID NO: 31835 - DNA, 16 bp, Artificial Sequence
  synthetic [barcode part1]
cgtaaggaatcactag

SEQ ID NO: 31836 - DNA, 16 bp, Artificial Sequence
  synthetic [barcode part1]
ccacggttagtatcag

SEQ ID NO: 31837 - DNA, 16 bp, Artificial Sequence
  synthetic [barcode part1]
gaggtctctgtagtgt

SEQ ID NO: 31838 - DNA, 16 bp, Artificial Sequence
  synthetic [barcode part1]
agaaccgtagtaggag

SEQ ID NO: 31839 - DNA, 16 bp, Artificial Sequence
  synthetic [barcode part1]
gcgtaatacgtgttgc

SEQ ID NO: 31840 - DNA, 16 bp, Artificial Sequence
  synthetic [barcode part1]
agttgtggttgtgtgc

SEQ ID NO: 31841 - DNA, 16 bp, Artificial Sequence
  synthetic [barcode part1]
tgagatcgttgactgc

SEQ ID NO: 31842 - DNA, 16 bp, Artificial Sequence
  synthetic [barcode part1]
ttctctcgaccagttc

SEQ ID NO: 31843 - DNA, 16 bp, Artificial Sequence
  synthetic [barcode part1]
cctgatagtggttcag

SEQ ID NO: 31844 - DNA, 16 bp, Artificial Sequence
  synthetic [barcode part1]
atactctgccactggc

SEQ ID NO: 31845 - DNA, 16 bp, Artificial Sequence
  synthetic [barcode part1]
caatcgatcgaccaac

SEQ ID NO: 31846 - DNA, 16 bp, Artificial Sequence
  synthetic [barcode part1]
tggccacttactaccg

SEQ ID NO: 31847 - DNA, 16 bp, Artificial Sequence
  synthetic [barcode part1]
taactccgatcctcct

SEQ ID NO: 31848 - DNA, 16 bp, Artificial Sequence
  synthetic [barcode part1]
gtccggaatagatctc

SEQ ID NO: 31849 - DNA, 16 bp, Artificial Sequence
  synthetic [barcode part1]
gcctgacttctgtacg

SEQ ID NO: 31850 - DNA, 16 bp, Artificial Sequence
  synthetic [barcode part1]
tgttgacctccagtcg

SEQ ID NO: 31851 - DNA, 16 bp, Artificial Sequence
  synthetic [barcode part1]
gcgattatcttccaac

SEQ ID NO: 31852 - DNA, 16 bp, Artificial Sequence
  synthetic [barcode part1]
ttctaacggaagtcgc

SEQ ID NO: 31853 - DNA, 16 bp, Artificial Sequence
  synthetic [barcode part1]
agatcgcacgacttgt

SEQ ID NO: 31854 - DNA, 16 bp, Artificial Sequence
  synthetic [barcode part1]
gtgataacagatccag

SEQ ID NO: 31855 - DNA, 16 bp, Artificial Sequence
  synthetic [barcode part1]
gacctagagtctggtt

SEQ ID NO: 31856 - DNA, 16 bp, Artificial Sequence
  synthetic [barcode part1]
cactggagagtgtggt

SEQ ID NO: 31857 - DNA, 16 bp, Artificial Sequence
  synthetic [barcode part1]
gaccaatccgaagttc

SEQ ID NO: 31858 - DNA, 16 bp, Artificial Sequence
  synthetic [barcode part1]
agtgtggtccagtgag

SEQ ID NO: 31859 - DNA, 16 bp, Artificial Sequence
  synthetic [barcode part1]
gtgaactcttcgtcgc

SEQ ID NO: 31860 - DNA, 16 bp, Artificial Sequence
  synthetic [barcode part1]
agtccagtcctgcact

SEQ ID NO: 31861 - DNA, 16 bp, Artificial Sequence
  synthetic [barcode part1]
ttaccgtgtcctacct

SEQ ID NO: 31862 - DNA, 16 bp, Artificial Sequence
  synthetic [barcode part1]
gtcactcctgttctac

SEQ ID NO: 31863 - DNA, 16 bp, Artificial Sequence
  synthetic [barcode part1]
taggttcttcgtcgcg

SEQ ID NO: 31864 - DNA, 16 bp, Artificial Sequence
  synthetic [barcode part1]
taacttctgcgcggtc

SEQ ID NO: 31865 - DNA, 16 bp, Artificial Sequence
  synthetic [barcode part1]
tctccttggtcttgac

SEQ ID NO: 31866 - DNA, 16 bp, Artificial Sequence
  synthetic [barcode part1]
tctaacgagtgacctg

SEQ ID NO: 31867 - DNA, 16 bp, Artificial Sequence
  synthetic [barcode part1]
ttggtggcacttccgt

SEQ ID NO: 31868 - DNA, 16 bp, Artificial Sequence
  synthetic [barcode part1]
cagacacacacgatct

SEQ ID NO: 31869 - DNA, 16 bp, Artificial Sequence
  synthetic [barcode part1]
cagtcagttggttggt

SEQ ID NO: 31870 - DNA, 16 bp, Artificial Sequence
  synthetic [barcode part1]
aatccggcaacgatct

SEQ ID NO: 31871 - DNA, 16 bp, Artificial Sequence
  synthetic [barcode part1]
aacgcaggataacttg

SEQ ID NO: 31872 - DNA, 16 bp, Artificial Sequence
  synthetic [barcode part1]
ccagatactaccttac

SEQ ID NO: 31873 - DNA, 16 bp, Artificial Sequence
  synthetic [barcode part1]
agaggtattgtcgagt

SEQ ID NO: 31874 - DNA, 16 bp, Artificial Sequence
  synthetic [barcode part1]
cgcgaatactcgtagt

SEQ ID NO: 31875 - DNA, 16 bp, Artificial Sequence
  synthetic [barcode part1]
tctgagtcagactcag

SEQ ID NO: 31876 - DNA, 16 bp, Artificial Sequence
  synthetic [barcode part1]
tagtaacgcgttctct

SEQ ID NO: 31877 - DNA, 16 bp, Artificial Sequence
  synthetic [barcode part1]
gtgaaggtgatctggc

SEQ ID NO: 31878 - DNA, 16 bp, Artificial Sequence
  synthetic [barcode part1]
cacgagtgagttcgtt

SEQ ID NO: 31879 - DNA, 16 bp, Artificial Sequence
  synthetic [barcode part1]
tgattcttgacacgtc

SEQ ID NO: 31880 - DNA, 16 bp, Artificial Sequence
  synthetic [barcode part1]
tgtcttgttgcggatt

SEQ ID NO: 31881 - DNA, 16 bp, Artificial Sequence
  synthetic [barcode part1]
gacactaattgtggcc

SEQ ID NO: 31882 - DNA, 16 bp, Artificial Sequence
  synthetic [barcode part1]
tgttgccttcagttcc

SEQ ID NO: 31883 - DNA, 16 bp, Artificial Sequence
  synthetic [barcode part1]
gttcagtcaacgactg

SEQ ID NO: 31884 - DNA, 16 bp, Artificial Sequence
  synthetic [barcode part1]
aggtacgtaataaccg

SEQ ID NO: 31885 - DNA, 16 bp, Artificial Sequence
  synthetic [barcode part1]
ccttatagaggtgcac

SEQ ID NO: 31886 - DNA, 16 bp, Artificial Sequence
  synthetic [barcode part1]
gtaacaaggtggcaag

SEQ ID NO: 31887 - DNA, 16 bp, Artificial Sequence
  synthetic [barcode part1]
cactaccactcgagtc

SEQ ID NO: 31888 - DNA, 16 bp, Artificial Sequence
  synthetic [barcode part1]
gtgagtcacactcagt

SEQ ID NO: 31889 - DNA, 16 bp, Artificial Sequence
  synthetic [barcode part1]
gaacactcaggtatcc

SEQ ID NO: 31890 - DNA, 16 bp, Artificial Sequence
  synthetic [barcode part1]
ccactactctgttacc

SEQ ID NO: 31891 - DNA, 16 bp, Artificial Sequence
  synthetic [barcode part1]
agtgccgtaatcagtc

SEQ ID NO: 31892 - DNA, 16 bp, Artificial Sequence
  synthetic [barcode part1]
taaggtccggttgatc

SEQ ID NO: 31893 - DNA, 16 bp, Artificial Sequence
  synthetic [barcode part1]
gagaggttgttagtac

SEQ ID NO: 31894 - DNA, 16 bp, Artificial Sequence
  synthetic [barcode part1]
cggtcacacggaatag

SEQ ID NO: 31895 - DNA, 16 bp, Artificial Sequence
  synthetic [barcode part1]
aattgagttcacggag

SEQ ID NO: 31896 - DNA, 16 bp, Artificial Sequence
  synthetic [barcode part1]
tcttgtacggttcggc

SEQ ID NO: 31897 - DNA, 16 bp, Artificial Sequence
  synthetic [barcode part1]
ttaccagttaggccag

SEQ ID NO: 31898 - DNA, 16 bp, Artificial Sequence
  synthetic [barcode part1]
ttcgattgcgtattgc

SEQ ID NO: 31899 - DNA, 16 bp, Artificial Sequence
  synthetic [barcode part1]
ccgtactcaagttgcc

SEQ ID NO: 31900 - DNA, 16 bp, Artificial Sequence
  synthetic [barcode part1]
agttatagtgtcggcc

SEQ ID NO: 31901 - DNA, 16 bp, Artificial Sequence
  synthetic [barcode part1]
tgacggaagatccacg

SEQ ID NO: 31902 - DNA, 16 bp, Artificial Sequence
  synthetic [barcode part1]
tcctgtatcaagtcgt

SEQ ID NO: 31903 - DNA, 16 bp, Artificial Sequence
  synthetic [barcode part1]
cggtcgtgaatatctg

SEQ ID NO: 31904 - DNA, 16 bp, Artificial Sequence
  synthetic [barcode part1]
cgagtgacagaatccg

SEQ ID NO: 31905 - DNA, 16 bp, Artificial Sequence
  synthetic [barcode part1]
aacaacctcttcgtac

SEQ ID NO: 31906 - DNA, 16 bp, Artificial Sequence
  synthetic [barcode part1]
cctcgcaaccgaactt

SEQ ID NO: 31907 - DNA, 16 bp, Artificial Sequence
  synthetic [barcode part1]
gtgtaggcaagtcgtg

SEQ ID NO: 31908 - DNA, 16 bp, Artificial Sequence
  synthetic [barcode part1]
tacggccaacctatag

SEQ ID NO: 31909 - DNA, 16 bp, Artificial Sequence
  synthetic [barcode part1]
gttggtaggtagtaac

SEQ ID NO: 31910 - DNA, 16 bp, Artificial Sequence
  synthetic [barcode part1]
gcagttaggtctcctc

SEQ ID NO: 31911 - DNA, 16 bp, Artificial Sequence
  synthetic [barcode part1]
tcactaggttgagtcg

SEQ ID NO: 31912 - DNA, 16 bp, Artificial Sequence
  synthetic [barcode part1]
tagtctcgcgttaact

SEQ ID NO: 31913 - DNA, 16 bp, Artificial Sequence
  synthetic [barcode part1]
atcacaaggactccgt

SEQ ID NO: 31914 - DNA, 16 bp, Artificial Sequence
  synthetic [barcode part1]
gcgcgactcaacttct

SEQ ID NO: 31915 - DNA, 16 bp, Artificial Sequence
  synthetic [barcode part1]
gaacctaatccggatc

SEQ ID NO: 31916 - DNA, 16 bp, Artificial Sequence
  synthetic [barcode part1]
tacgttgcagtgtacg

SEQ ID NO: 31917 - DNA, 16 bp, Artificial Sequence
  synthetic [barcode part1]
tgacgttgcagtgttg

SEQ ID NO: 31918 - DNA, 16 bp, Artificial Sequence
  synthetic [barcode part1]
tcagaggacgtaattg

SEQ ID NO: 31919 - DNA, 16 bp, Artificial Sequence
  synthetic [barcode part1]
tctgaccttgaggaac

SEQ ID NO: 31920 - DNA, 16 bp, Artificial Sequence
  synthetic [barcode part1]
gtaccgaaccgaaggt

SEQ ID NO: 31921 - DNA, 16 bp, Artificial Sequence
  synthetic [barcode part1]
gaggtgaggtactcac

SEQ ID NO: 31922 - DNA, 16 bp, Artificial Sequence
  synthetic [barcode part1]
cacctcttaacttgag

SEQ ID NO: 31923 - DNA, 16 bp, Artificial Sequence
  synthetic [barcode part1]
gttacggcgcctatct

SEQ ID NO: 31924 - DNA, 16 bp, Artificial Sequence
  synthetic [barcode part1]
gttcactggtgttact

SEQ ID NO: 31925 - DNA, 16 bp, Artificial Sequence
  synthetic [barcode part1]
acgtctctaactcggc

SEQ ID NO: 31926 - DNA, 16 bp, Artificial Sequence
  synthetic [barcode part1]
taccagacaaggacgc

SEQ ID NO: 31927 - DNA, 16 bp, Artificial Sequence
  synthetic [barcode part1]
gaccaccagacacaag

SEQ ID NO: 31928 - DNA, 16 bp, Artificial Sequence
  synthetic [barcode part1]
aaccaactcttgaggc

SEQ ID NO: 31929 - DNA, 16 bp, Artificial Sequence
  synthetic [barcode part1]
accgttagtcgaactg

SEQ ID NO: 31930 - DNA, 16 bp, Artificial Sequence
  synthetic [barcode part1]
gacagaacagtggagt

SEQ ID NO: 31931 - DNA, 16 bp, Artificial Sequence
  synthetic [barcode part1]
acgagttccttattgc

SEQ ID NO: 31932 - DNA, 16 bp, Artificial Sequence
  synthetic [barcode part1]
cacttactaggcgagt

SEQ ID NO: 31933 - DNA, 16 bp, Artificial Sequence
  synthetic [barcode part1]
atccaaggagttcacc

SEQ ID NO: 31934 - DNA, 16 bp, Artificial Sequence
  synthetic [barcode part1]
gccttaatcagagtcg

SEQ ID NO: 31935 - DNA, 16 bp, Artificial Sequence
  synthetic [barcode part1]
gcacaacgttgacgtt

SEQ ID NO: 31936 - DNA, 16 bp, Artificial Sequence
  synthetic [barcode part1]
cctagtcgttgtatac

SEQ ID NO: 31937 - DNA, 16 bp, Artificial Sequence
  synthetic [barcode part1]
cgttagtagagtcaag

SEQ ID NO: 31938 - DNA, 16 bp, Artificial Sequence
  synthetic [barcode part1]
acgcgacaatcaaggc

SEQ ID NO: 31939 - DNA, 16 bp, Artificial Sequence
  synthetic [barcode part1]
aggagactgccaacac

SEQ ID NO: 31940 - DNA, 16 bp, Artificial Sequence
  synthetic [barcode part1]
gacgaagttagacgcc

SEQ ID NO: 31941 - DNA, 16 bp, Artificial Sequence
  synthetic [barcode part1]
tcctattgacgagacg

SEQ ID NO: 31942 - DNA, 16 bp, Artificial Sequence
  synthetic [barcode part1]
acagtcgttaggaagt

SEQ ID NO: 31943 - DNA, 16 bp, Artificial Sequence
  synthetic [barcode part1]
acttgactcttgtgtg

SEQ ID NO: 31944 - DNA, 16 bp, Artificial Sequence
  synthetic [barcode part1]
gtcagtgttactacct

SEQ ID NO: 31945 - DNA, 16 bp, Artificial Sequence
  synthetic [barcode part1]
tacgtccaggtcactc

SEQ ID NO: 31946 - DNA, 16 bp, Artificial Sequence
  synthetic [barcode part1]
acggtacacgttacgt

SEQ ID NO: 31947 - DNA, 16 bp, Artificial Sequence
  synthetic [barcode part1]
aggccaactagtcttg

SEQ ID NO: 31948 - DNA, 16 bp, Artificial Sequence
  synthetic [barcode part1]
gaatctaccactgtct

SEQ ID NO: 31949 - DNA, 16 bp, Artificial Sequence
  synthetic [barcode part1]
gtgactggtactggtt

SEQ ID NO: 31950 - DNA, 16 bp, Artificial Sequence
  synthetic [barcode part1]
aactcctaacttgcgt

SEQ ID NO: 31951 - DNA, 16 bp, Artificial Sequence
  synthetic [barcode part1]
gtacctcacacttctc

SEQ ID NO: 31952 - DNA, 16 bp, Artificial Sequence
  synthetic [barcode part1]
agattatcggaagtgc

SEQ ID NO: 31953 - DNA, 16 bp, Artificial Sequence
  synthetic [barcode part1]
tcggtatcacggttag

SEQ ID NO: 31954 - DNA, 16 bp, Artificial Sequence
  synthetic [barcode part1]
actcaccgcaatattc

SEQ ID NO: 31955 - DNA, 16 bp, Artificial Sequence
  synthetic [barcode part1]
gaggttcgtggacagt

SEQ ID NO: 31956 - DNA, 16 bp, Artificial Sequence
  synthetic [barcode part1]
gagtgaactcaagact

SEQ ID NO: 31957 - DNA, 16 bp, Artificial Sequence
  synthetic [barcode part1]
atcttactaggcctac

SEQ ID NO: 31958 - DNA, 16 bp, Artificial Sequence
  synthetic [barcode part1]
ccaaggtaatagacgt

SEQ ID NO: 31959 - DNA, 16 bp, Artificial Sequence
  synthetic [barcode part1]
atagagaatcaccgac

SEQ ID NO: 31960 - DNA, 16 bp, Artificial Sequence
  synthetic [barcode part1]
acctaccgttccgaac

SEQ ID NO: 31961 - DNA, 16 bp, Artificial Sequence
  synthetic [barcode part1]
agacacggtattcctg

SEQ ID NO: 31962 - DNA, 16 bp, Artificial Sequence
  synthetic [barcode part1]
aatacgcctaaccttc

SEQ ID NO: 31963 - DNA, 16 bp, Artificial Sequence
  synthetic [barcode part1]
tatcggaactcaacgc

SEQ ID NO: 31964 - DNA, 16 bp, Artificial Sequence
  synthetic [barcode part1]
acctcgtctgtgcaac

SEQ ID NO: 31965 - DNA, 16 bp, Artificial Sequence
  synthetic [barcode part1]
gattcgattaacggcc

SEQ ID NO: 31966 - DNA, 16 bp, Artificial Sequence
  synthetic [barcode part1]
gtcgagtcgtcgaatt

SEQ ID NO: 31967 - DNA, 16 bp, Artificial Sequence
  synthetic [barcode part1]
actcactgacgttact

SEQ ID NO: 31968 - DNA, 16 bp, Artificial Sequence
  synthetic [barcode part1]
gatagttcgcaagagt

SEQ ID NO: 31969 - DNA, 16 bp, Artificial Sequence
  synthetic [barcode part1]
tggtgccttacaacag

SEQ ID NO: 31970 - DNA, 16 bp, Artificial Sequence
  synthetic [barcode part1]
tagtcgttgaagaacg

SEQ ID NO: 31971 - DNA, 16 bp, Artificial Sequence
  synthetic [barcode part1]
gcactcttcaacaatc

SEQ ID NO: 31972 - DNA, 16 bp, Artificial Sequence
  synthetic [barcode part1]
gcagacaggatcctag

SEQ ID NO: 31973 - DNA, 16 bp, Artificial Sequence
  synthetic [barcode part1]
cgagaaggtatcgacc

SEQ ID NO: 31974 - DNA, 16 bp, Artificial Sequence
  synthetic [barcode part1]
attccttagaggaccg

SEQ ID NO: 31975 - DNA, 16 bp, Artificial Sequence
  synthetic [barcode part1]
gaagttcaagttccgc

SEQ ID NO: 31976 - DNA, 16 bp, Artificial Sequence
  synthetic [barcode part1]
cgaataagaacctcag

SEQ ID NO: 31977 - DNA, 16 bp, Artificial Sequence
  synthetic [barcode part1]
ttggcaaggtagttcc

SEQ ID NO: 31978 - DNA, 16 bp, Artificial Sequence
  synthetic [barcode part1]
gttctgtcttggcctt

SEQ ID NO: 31979 - DNA, 16 bp, Artificial Sequence
  synthetic [barcode part1]
tcaagacacgaacaac

SEQ ID NO: 31980 - DNA, 16 bp, Artificial Sequence
  synthetic [barcode part1]
tctcaccgtaggttcg

SEQ ID NO: 31981 - DNA, 16 bp, Artificial Sequence
  synthetic [barcode part1]
acgacacaagactcct

SEQ ID NO: 31982 - DNA, 16 bp, Artificial Sequence
  synthetic [barcode part1]
tgatacaggtcgcact

SEQ ID NO: 31983 - DNA, 16 bp, Artificial Sequence
  synthetic [barcode part1]
taacgcactcttgatc

SEQ ID NO: 31984 - DNA, 16 bp, Artificial Sequence
  synthetic [barcode part1]
ttagataaggcggtac

SEQ ID NO: 31985 - DNA, 16 bp, Artificial Sequence
  synthetic [barcode part1]
tcctcgatataactgc

SEQ ID NO: 31986 - DNA, 16 bp, Artificial Sequence
  synthetic [barcode part1]
cctgttccactgcaag

SEQ ID NO: 31987 - DNA, 16 bp, Artificial Sequence
  synthetic [barcode part1]
ccgttctagaacaacg

SEQ ID NO: 31988 - DNA, 16 bp, Artificial Sequence
  synthetic [barcode part1]
tacggacacggcaagt

SEQ ID NO: 31989 - DNA, 16 bp, Artificial Sequence
  synthetic [barcode part1]
tgccggtgaagagttg

SEQ ID NO: 31990 - DNA, 16 bp, Artificial Sequence
  synthetic [barcode part1]
aagtccgagtggcagt

SEQ ID NO: 31991 - DNA, 16 bp, Artificial Sequence
  synthetic [barcode part1]
taagtacgccgcctct

SEQ ID NO: 31992 - DNA, 16 bp, Artificial Sequence
  synthetic [barcode part1]
tagtctgcgcctctag

SEQ ID NO: 31993 - DNA, 16 bp, Artificial Sequence
  synthetic [barcode part1]
ccgaagatcagacacg

SEQ ID NO: 31994 - DNA, 16 bp, Artificial Sequence
  synthetic [barcode part1]
aactcaccggaataag

SEQ ID NO: 31995 - DNA, 16 bp, Artificial Sequence
  synthetic [barcode part1]
gtatcctatcaggtct

SEQ ID NO: 31996 - DNA, 16 bp, Artificial Sequence
  synthetic [barcode part1]
gacttcactcgcctag

SEQ ID NO: 31997 - DNA, 16 bp, Artificial Sequence
  synthetic [barcode part1]
tccgatccaactgcac

SEQ ID NO: 31998 - DNA, 16 bp, Artificial Sequence
  synthetic [barcode part1]
tgtacgttcagagtcg

SEQ ID NO: 31999 - DNA, 16 bp, Artificial Sequence
  synthetic [barcode part1]
gagacacttctcacag

SEQ ID NO: 32000 - DNA, 16 bp, Artificial Sequence
  synthetic [barcode part1]
acacgtattggccaac

SEQ ID NO: 32001 - DNA, 16 bp, Artificial Sequence
  synthetic [barcode part1]
atccttgtaccaggtt

SEQ ID NO: 32002 - DNA, 16 bp, Artificial Sequence
  synthetic [barcode part1]
cgaacgtagtcacgtt

SEQ ID NO: 32003 - DNA, 16 bp, Artificial Sequence
  synthetic [barcode part1]
tctgaacgtgaggcag

SEQ ID NO: 32004 - DNA, 16 bp, Artificial Sequence
  synthetic [barcode part1]
acaagtacctaaggtg

SEQ ID NO: 32005 - DNA, 16 bp, Artificial Sequence
  synthetic [barcode part1]
attcgaccttccgcag

SEQ ID NO: 32006 - DNA, 16 bp, Artificial Sequence
  synthetic [barcode part1]
tattctgcggaacgac

SEQ ID NO: 32007 - DNA, 16 bp, Artificial Sequence
  synthetic [barcode part1]
gatacggacaagagtg

SEQ ID NO: 32008 - DNA, 16 bp, Artificial Sequence
  synthetic [barcode part1]
caagtaataccgtgag

SEQ ID NO: 32009 - DNA, 16 bp, Artificial Sequence
  synthetic [barcode part1]
tactctatctaggcac

SEQ ID NO: 32010 - DNA, 16 bp, Artificial Sequence
  synthetic [barcode part1]
tctgagacttcaggac

SEQ ID NO: 32011 - DNA, 16 bp, Artificial Sequence
  synthetic [barcode part1]
tcaccactcgcagatc

SEQ ID NO: 32012 - DNA, 16 bp, Artificial Sequence
  synthetic [barcode part1]
cgattctagaaggcct

SEQ ID NO: 32013 - DNA, 16 bp, Artificial Sequence
  synthetic [barcode part1]
gacttcctgtattgac

SEQ ID NO: 32014 - DNA, 16 bp, Artificial Sequence
  synthetic [barcode part1]
ttacggtgccagttag

SEQ ID NO: 32015 - DNA, 16 bp, Artificial Sequence
  synthetic [barcode part1]
taggatagatacgtcg

SEQ ID NO: 32016 - DNA, 16 bp, Artificial Sequence
  synthetic [barcode part1]
gcgttcggaataatag

SEQ ID NO: 32017 - DNA, 16 bp, Artificial Sequence
  synthetic [barcode part1]
tcaccggactgaattg

SEQ ID NO: 32018 - DNA, 16 bp, Artificial Sequence
  synthetic [barcode part1]
tggtgatagttgtcgc

SEQ ID NO: 32019 - DNA, 16 bp, Artificial Sequence
  synthetic [barcode part1]
actcgtagatcacacg

SEQ ID NO: 32020 - DNA, 16 bp, Artificial Sequence
  synthetic [barcode part1]
gccacgattacttgcc

SEQ ID NO: 32021 - DNA, 16 bp, Artificial Sequence
  synthetic [barcode part1]
cgttccttagtccgag

SEQ ID NO: 32022 - DNA, 16 bp, Artificial Sequence
  synthetic [barcode part1]
cgtcgaactgcactct

SEQ ID NO: 32023 - DNA, 16 bp, Artificial Sequence
  synthetic [barcode part1]
tcctggcaggatagtt

SEQ ID NO: 32024 - DNA, 16 bp, Artificial Sequence
  synthetic [barcode part1]
tccaacagtggttcag

SEQ ID NO: 32025 - DNA, 16 bp, Artificial Sequence
  synthetic [barcode part1]
gatcgtgcacgattgt

SEQ ID NO: 32026 - DNA, 16 bp, Artificial Sequence
  synthetic [barcode part1]
tgatcggattgcggtt

SEQ ID NO: 32027 - DNA, 16 bp, Artificial Sequence
  synthetic [barcode part1]
gtctcaagaagaggag

SEQ ID NO: 32028 - DNA, 16 bp, Artificial Sequence
  synthetic [barcode part1]
acggagttatcgtctg

SEQ ID NO: 32029 - DNA, 16 bp, Artificial Sequence
  synthetic [barcode part1]
aggtcagacaccaacg

SEQ ID NO: 32030 - DNA, 16 bp, Artificial Sequence
  synthetic [barcode part1]
ttgtcgagactcagtg

SEQ ID NO: 32031 - DNA, 16 bp, Artificial Sequence
  synthetic [barcode part1]
tcaacaggtccttatc

SEQ ID NO: 32032 - DNA, 16 bp, Artificial Sequence
  synthetic [barcode part1]
cggaatcagttccagt

SEQ ID NO: 32033 - DNA, 16 bp, Artificial Sequence
  synthetic [barcode part1]
agtactggccgattac

SEQ ID NO: 32034 - DNA, 16 bp, Artificial Sequence
  synthetic [barcode part1]
tgtgttccggaagtgt

SEQ ID NO: 32035 - DNA, 16 bp, Artificial Sequence
  synthetic [barcode part1]
gtgtgtacacgtacac

SEQ ID NO: 32036 - DNA, 16 bp, Artificial Sequence
  synthetic [barcode part1]
gttgttgcgtactccg

SEQ ID NO: 32037 - DNA, 16 bp, Artificial Sequence
  synthetic [barcode part1]
tagtaagttgcgaacg

SEQ ID NO: 32038 - DNA, 16 bp, Artificial Sequence
  synthetic [barcode part1]
atactcgccgtctcag

SEQ ID NO: 32039 - DNA, 16 bp, Artificial Sequence
  synthetic [barcode part1]
agacgaattcaggact

SEQ ID NO: 32040 - DNA, 16 bp, Artificial Sequence
  synthetic [barcode part1]
cgtacttccaccaggt

SEQ ID NO: 32041 - DNA, 16 bp, Artificial Sequence
  synthetic [barcode part1]
cagtactccactcgtg

SEQ ID NO: 32042 - DNA, 16 bp, Artificial Sequence
  synthetic [barcode part1]
ttgttgccgagacagt

SEQ ID NO: 32043 - DNA, 16 bp, Artificial Sequence
  synthetic [barcode part1]
actcgtctgcctattc

SEQ ID NO: 32044 - DNA, 16 bp, Artificial Sequence
  synthetic [barcode part1]
tgtcacttccacaagt

SEQ ID NO: 32045 - DNA, 16 bp, Artificial Sequence
  synthetic [barcode part1]
ataaccacgcgcagtt

SEQ ID NO: 32046 - DNA, 16 bp, Artificial Sequence
  synthetic [barcode part1]
ttggaacctcgcctac

SEQ ID NO: 32047 - DNA, 16 bp, Artificial Sequence
  synthetic [barcode part1]
gcacgcgtaatactgt

SEQ ID NO: 32048 - DNA, 16 bp, Artificial Sequence
  synthetic [barcode part1]
atagaggtcaggccgt

SEQ ID NO: 32049 - DNA, 16 bp, Artificial Sequence
  synthetic [barcode part1]
ttgccaatcgacaacg

SEQ ID NO: 32050 - DNA, 16 bp, Artificial Sequence
  synthetic [barcode part1]
tactactgcggttatc

SEQ ID NO: 32051 - DNA, 16 bp, Artificial Sequence
  synthetic [barcode part1]
cgacaacgttgttggt

SEQ ID NO: 32052 - DNA, 16 bp, Artificial Sequence
  synthetic [barcode part1]
atcttgtggtacactc

SEQ ID NO: 32053 - DNA, 16 bp, Artificial Sequence
  synthetic [barcode part1]
gactcgagacttggtt

SEQ ID NO: 32054 - DNA, 16 bp, Artificial Sequence
  synthetic [barcode part1]
tacgagtctgcagatc

SEQ ID NO: 32055 - DNA, 16 bp, Artificial Sequence
  synthetic [barcode part1]
gttcttacaccaagtc

SEQ ID NO: 32056 - DNA, 16 bp, Artificial Sequence
  synthetic [barcode part1]
gacgtaggaactgtcg

SEQ ID NO: 32057 - DNA, 16 bp, Artificial Sequence
  synthetic [barcode part1]
tgtgaggcgatagtcg

SEQ ID NO: 32058 - DNA, 16 bp, Artificial Sequence
  synthetic [barcode part1]
gcgcacttgaagagtg

SEQ ID NO: 32059 - DNA, 16 bp, Artificial Sequence
  synthetic [barcode part1]
gactccgaatactgtg

SEQ ID NO: 32060 - DNA, 16 bp, Artificial Sequence
  synthetic [barcode part1]
taggactgttgcagtc

SEQ ID NO: 32061 - DNA, 16 bp, Artificial Sequence
  synthetic [barcode part1]
ttggcgcagaattaag

SEQ ID NO: 32062 - DNA, 16 bp, Artificial Sequence
  synthetic [barcode part1]
tcttcgcgcaactcag

SEQ ID NO: 32063 - DNA, 16 bp, Artificial Sequence
  synthetic [barcode part1]
cggcgtataataagac

SEQ ID NO: 32064 - DNA, 16 bp, Artificial Sequence
  synthetic [barcode part1]
caatcctaccggcgtt

SEQ ID NO: 32065 - DNA, 16 bp, Artificial Sequence
  synthetic [barcode part1]
aacgtaattcgcgtcg

SEQ ID NO: 32066 - DNA, 16 bp, Artificial Sequence
  synthetic [barcode part1]
gtcttagtctcaggag

SEQ ID NO: 32067 - DNA, 16 bp, Artificial Sequence
  synthetic [barcode part1]
tattctggtggcgaac

SEQ ID NO: 32068 - DNA, 16 bp, Artificial Sequence
  synthetic [barcode part1]
gagacacttctacgtg

SEQ ID NO: 32069 - DNA, 16 bp, Artificial Sequence
  synthetic [barcode part1]
agaggaatagtcgacg

SEQ ID NO: 32070 - DNA, 16 bp, Artificial Sequence
  synthetic [barcode part1]
agtcgacgccaattgt

SEQ ID NO: 32071 - DNA, 16 bp, Artificial Sequence
  synthetic [barcode part1]
actcacaacacctgag

SEQ ID NO: 32072 - DNA, 16 bp, Artificial Sequence
  synthetic [barcode part1]
agtcgacactagtcgt

SEQ ID NO: 32073 - DNA, 16 bp, Artificial Sequence
  synthetic [barcode part1]
gtggaacagacctacg

SEQ ID NO: 32074 - DNA, 16 bp, Artificial Sequence
  synthetic [barcode part1]
acttggagtccgtaac

SEQ ID NO: 32075 - DNA, 16 bp, Artificial Sequence
  synthetic [barcode part1]
tgagtcggtgccttct

SEQ ID NO: 32076 - DNA, 16 bp, Artificial Sequence
  synthetic [barcode part1]
tgccgaattaccaggt

SEQ ID NO: 32077 - DNA, 16 bp, Artificial Sequence
  synthetic [barcode part1]
taggatccagtgtcac

SEQ ID NO: 32078 - DNA, 16 bp, Artificial Sequence
  synthetic [barcode part1]
ttcactagtcgaggac

SEQ ID NO: 32079 - DNA, 16 bp, Artificial Sequence
  synthetic [barcode part1]
gactcgcaataggacg

SEQ ID NO: 32080 - DNA, 16 bp, Artificial Sequence
  synthetic [barcode part1]
agtctccacacgactc

SEQ ID NO: 32081 - DNA, 16 bp, Artificial Sequence
  synthetic [barcode part1]
caactactaaggaacg

SEQ ID NO: 32082 - DNA, 16 bp, Artificial Sequence
  synthetic [barcode part1]
gactctcaatcgtatc

SEQ ID NO: 32083 - DNA, 16 bp, Artificial Sequence
  synthetic [barcode part1]
gtacgacctctctggt

SEQ ID NO: 32084 - DNA, 16 bp, Artificial Sequence
  synthetic [barcode part1]
cgaaccaactgagtct

SEQ ID NO: 32085 - DNA, 16 bp, Artificial Sequence
  synthetic [barcode part1]
caggccaagttcaatc

SEQ ID NO: 32086 - DNA, 16 bp, Artificial Sequence
  synthetic [barcode part1]
ttgtcgcgacaagatc

SEQ ID NO: 32087 - DNA, 16 bp, Artificial Sequence
  synthetic [barcode part1]
tcaccactgttcaggc

SEQ ID NO: 32088 - DNA, 16 bp, Artificial Sequence
  synthetic [barcode part1]
tgcagacttcagacgt

SEQ ID NO: 32089 - DNA, 16 bp, Artificial Sequence
  synthetic [barcode part1]
tggtcaacggttgatc

SEQ ID NO: 32090 - DNA, 16 bp, Artificial Sequence
  synthetic [barcode part1]
gtctctgtaccaggtc

SEQ ID NO: 32091 - DNA, 16 bp, Artificial Sequence
  synthetic [barcode part1]
ttctgcggtcggattc

SEQ ID NO: 32092 - DNA, 16 bp, Artificial Sequence
  synthetic [barcode part1]
aattcggacgcgagac

SEQ ID NO: 32093 - DNA, 16 bp, Artificial Sequence
  synthetic [barcode part1]
gacacgcgtattaacc

SEQ ID NO: 32094 - DNA, 16 bp, Artificial Sequence
  synthetic [barcode part1]
caggccgattagactt

SEQ ID NO: 32095 - DNA, 16 bp, Artificial Sequence
  synthetic [barcode part1]
cgccttacagagtaac

SEQ ID NO: 32096 - DNA, 16 bp, Artificial Sequence
  synthetic [barcode part1]
tctgttggccgttctt

SEQ ID NO: 32097 - DNA, 16 bp, Artificial Sequence
  synthetic [barcode part1]
tggcgtagtgtgactt

SEQ ID NO: 32098 - DNA, 16 bp, Artificial Sequence
  synthetic [barcode part1]
gcgcggtcaatatact

SEQ ID NO: 32099 - DNA, 16 bp, Artificial Sequence
  synthetic [barcode part1]
tcacacaggccttctg

SEQ ID NO: 32100 - DNA, 16 bp, Artificial Sequence
  synthetic [barcode part1]
cgtgaattaccacttc

SEQ ID NO: 32101 - DNA, 16 bp, Artificial Sequence
  synthetic [barcode part1]
caccaagttacacctt

SEQ ID NO: 32102 - DNA, 16 bp, Artificial Sequence
  synthetic [barcode part1]
cgaggtaggtacactg

SEQ ID NO: 32103 - DNA, 16 bp, Artificial Sequence
  synthetic [barcode part1]
cggttagttagtcggt

SEQ ID NO: 32104 - DNA, 16 bp, Artificial Sequence
  synthetic [barcode part1]
gagtataaccaggccg

SEQ ID NO: 32105 - DNA, 16 bp, Artificial Sequence
  synthetic [barcode part1]
aatacaccgcgtgact

SEQ ID NO: 32106 - DNA, 16 bp, Artificial Sequence
  synthetic [barcode part1]
cacttactaggatcct

SEQ ID NO: 32107 - DNA, 16 bp, Artificial Sequence
  synthetic [barcode part1]
cgagacctaacactac

SEQ ID NO: 32108 - DNA, 16 bp, Artificial Sequence
  synthetic [barcode part1]
acgcgacaatctctcc

SEQ ID NO: 32109 - DNA, 16 bp, Artificial Sequence
  synthetic [barcode part1]
aacgtgtacactgacc

SEQ ID NO: 32110 - DNA, 16 bp, Artificial Sequence
  synthetic [barcode part1]
cactgagatcttcgtt

SEQ ID NO: 32111 - DNA, 16 bp, Artificial Sequence
  synthetic [barcode part1]
tctgtagattctaccg

SEQ ID NO: 32112 - DNA, 16 bp, Artificial Sequence
  synthetic [barcode part1]
tcagagtgtccgtctc

SEQ ID NO: 32113 - DNA, 16 bp, Artificial Sequence
  synthetic [barcode part1]
agaagtattgccgaac

SEQ ID NO: 32114 - DNA, 16 bp, Artificial Sequence
  synthetic [barcode part1]
aaggtatcggtgattg

SEQ ID NO: 32115 - DNA, 16 bp, Artificial Sequence
  synthetic [barcode part1]
tatagtacaggtggac

SEQ ID NO: 32116 - DNA, 16 bp, Artificial Sequence
  synthetic [barcode part1]
tcactcgttgtgacgc

SEQ ID NO: 32117 - DNA, 16 bp, Artificial Sequence
  synthetic [barcode part1]
tcgaacggtaggttct

SEQ ID NO: 32118 - DNA, 16 bp, Artificial Sequence
  synthetic [barcode part1]
cacagttctaacgcag

SEQ ID NO: 32119 - DNA, 16 bp, Artificial Sequence
  synthetic [barcode part1]
agtatattgaccgcgc

SEQ ID NO: 32120 - DNA, 16 bp, Artificial Sequence
  synthetic [barcode part1]
taccttaccacaggcc

SEQ ID NO: 32121 - DNA, 16 bp, Artificial Sequence
  synthetic [barcode part1]
actctgagatcaaccg

SEQ ID NO: 32122 - DNA, 16 bp, Artificial Sequence
  synthetic [barcode part1]
tactgcacagtgtcag

SEQ ID NO: 32123 - DNA, 16 bp, Artificial Sequence
  synthetic [barcode part1]
gtatagaggtgtggag

SEQ ID NO: 32124 - DNA, 16 bp, Artificial Sequence
  synthetic [barcode part1]
cacgttactcttcaag

SEQ ID NO: 32125 - DNA, 16 bp, Artificial Sequence
  synthetic [barcode part1]
gtacgttgtaatcgcg

SEQ ID NO: 32126 - DNA, 16 bp, Artificial Sequence
  synthetic [barcode part1]
gataagtcgttgtgag

SEQ ID NO: 32127 - DNA, 16 bp, Artificial Sequence
  synthetic [barcode part1]
cgaggtatccgtgaag

SEQ ID NO: 32128 - DNA, 16 bp, Artificial Sequence
  synthetic [barcode part1]
gcggttacgtgtaact

SEQ ID NO: 32129 - DNA, 16 bp, Artificial Sequence
  synthetic [barcode part1]
ttgacaggccttcgtc

SEQ ID NO: 32130 - DNA, 16 bp, Artificial Sequence
  synthetic [barcode part1]
gtccacgtaacctctg

SEQ ID NO: 32131 - DNA, 16 bp, Artificial Sequence
  synthetic [barcode part1]
cacacttagtggtctt

SEQ ID NO: 32132 - DNA, 16 bp, Artificial Sequence
  synthetic [barcode part1]
ttcggttacaccaact

SEQ ID NO: 32133 - DNA, 16 bp, Artificial Sequence
  synthetic [barcode part1]
tagttcttacggccgc

SEQ ID NO: 32134 - DNA, 16 bp, Artificial Sequence
  synthetic [barcode part1]
tgtataaccacgcgac

SEQ ID NO: 32135 - DNA, 16 bp, Artificial Sequence
  synthetic [barcode part1]
gaatccacacttcgcc

SEQ ID NO: 32136 - DNA, 16 bp, Artificial Sequence
  synthetic [barcode part1]
ataacgacgaacctag

SEQ ID NO: 32137 - DNA, 16 bp, Artificial Sequence
  synthetic [barcode part1]
agtactcgcaggacag

SEQ ID NO: 32138 - DNA, 16 bp, Artificial Sequence
  synthetic [barcode part1]
gacttgacgacaactc

SEQ ID NO: 32139 - DNA, 16 bp, Artificial Sequence
  synthetic [barcode part1]
attgaccgattccgag

SEQ ID NO: 32140 - DNA, 16 bp, Artificial Sequence
  synthetic [barcode part1]
aactcaacggtgacct

SEQ ID NO: 32141 - DNA, 16 bp, Artificial Sequence
  synthetic [barcode part1]
tgaaggatccttcggt

SEQ ID NO: 32142 - DNA, 16 bp, Artificial Sequence
  synthetic [barcode part1]
aatagagtcggacgcc

SEQ ID NO: 32143 - DNA, 16 bp, Artificial Sequence
  synthetic [barcode part1]
gtagtcggttacacgt

SEQ ID NO: 32144 - DNA, 16 bp, Artificial Sequence
  synthetic [barcode part1]
cgcagacagtggaatc

SEQ ID NO: 32145 - DNA, 16 bp, Artificial Sequence
  synthetic [barcode part1]
aagattgcgtgaatcg

SEQ ID NO: 32146 - DNA, 16 bp, Artificial Sequence
  synthetic [barcode part1]
tatctctctggtagtg

SEQ ID NO: 32147 - DNA, 16 bp, Artificial Sequence
  synthetic [barcode part1]
cgaatatctcctggtt

SEQ ID NO: 32148 - DNA, 16 bp, Artificial Sequence
  synthetic [barcode part1]
acggacaatctacctg

SEQ ID NO: 32149 - DNA, 16 bp, Artificial Sequence
  synthetic [barcode part1]
gaggaactactaacac

SEQ ID NO: 32150 - DNA, 16 bp, Artificial Sequence
  synthetic [barcode part1]
gttaacgaacgtgtcc

SEQ ID NO: 32151 - DNA, 16 bp, Artificial Sequence
  synthetic [barcode part1]
gagtccagtctgaact

SEQ ID NO: 32152 - DNA, 16 bp, Artificial Sequence
  synthetic [barcode part1]
ccttcgattctggttc

SEQ ID NO: 32153 - DNA, 16 bp, Artificial Sequence
  synthetic [barcode part1]
accaggagtcgtacag

SEQ ID NO: 32154 - DNA, 16 bp, Artificial Sequence
  synthetic [barcode part1]
attcttggttcagtgc

SEQ ID NO: 32155 - DNA, 16 bp, Artificial Sequence
  synthetic [barcode part1]
gatcactcttgcgtcg

SEQ ID NO: 32156 - DNA, 16 bp, Artificial Sequence
  synthetic [barcode part1]
gtgaacgatctacctg

SEQ ID NO: 32157 - DNA, 16 bp, Artificial Sequence
  synthetic [barcode part1]
tataacgccgttcgtt

SEQ ID NO: 32158 - DNA, 16 bp, Artificial Sequence
  synthetic [barcode part1]
ttacctacgagattcc

SEQ ID NO: 32159 - DNA, 16 bp, Artificial Sequence
  synthetic [barcode part1]
tgtactgacaccaacg

SEQ ID NO: 32160 - DNA, 16 bp, Artificial Sequence
  synthetic [barcode part1]
tctggttgttgacgtt

SEQ ID NO: 32161 - DNA, 16 bp, Artificial Sequence
  synthetic [barcode part1]
ccgcgttatagagact

SEQ ID NO: 32162 - DNA, 16 bp, Artificial Sequence
  synthetic [barcode part1]
tgtgtaggacaacaac

SEQ ID NO: 32163 - DNA, 16 bp, Artificial Sequence
  synthetic [barcode part1]
ttaccacgcggacctt

SEQ ID NO: 32164 - DNA, 16 bp, Artificial Sequence
  synthetic [barcode part1]
aattctcgccactctc

SEQ ID NO: 32165 - DNA, 16 bp, Artificial Sequence
  synthetic [barcode part1]
gattcttcctccgatc

SEQ ID NO: 32166 - DNA, 16 bp, Artificial Sequence
  synthetic [barcode part1]
aaggtctgttcacttc

SEQ ID NO: 32167 - DNA, 16 bp, Artificial Sequence
  synthetic [barcode part1]
aagtctgaagtgcctc

SEQ ID NO: 32168 - DNA, 16 bp, Artificial Sequence
  synthetic [barcode part1]
taagagtgtgactcag

SEQ ID NO: 32169 - DNA, 16 bp, Artificial Sequence
  synthetic [barcode part1]
agtctggcaatctggt

SEQ ID NO: 32170 - DNA, 16 bp, Artificial Sequence
  synthetic [barcode part1]
ccagtctagatattcc

SEQ ID NO: 32171 - DNA, 16 bp, Artificial Sequence
  synthetic [barcode part1]
tccgttccttggagtg

SEQ ID NO: 32172 - DNA, 16 bp, Artificial Sequence
  synthetic [barcode part1]
aggtaggtctatctgc

SEQ ID NO: 32173 - DNA, 16 bp, Artificial Sequence
  synthetic [barcode part1]
atcggttaagacctcg

SEQ ID NO: 32174 - DNA, 16 bp, Artificial Sequence
  synthetic [barcode part1]
gttggtggtggttgtt

SEQ ID NO: 32175 - DNA, 16 bp, Artificial Sequence
  synthetic [barcode part1]
tcctcgtcttgtactg

SEQ ID NO: 32176 - DNA, 16 bp, Artificial Sequence
  synthetic [barcode part1]
caactccacgtactgc

SEQ ID NO: 32177 - DNA, 16 bp, Artificial Sequence
  synthetic [barcode part1]
agatcaatacacgacg

SEQ ID NO: 32178 - DNA, 16 bp, Artificial Sequence
  synthetic [barcode part1]
gcactagtcagtacgt

SEQ ID NO: 32179 - DNA, 16 bp, Artificial Sequence
  synthetic [barcode part1]
ccgacgttcttaaccg

SEQ ID NO: 32180 - DNA, 16 bp, Artificial Sequence
  synthetic [barcode part1]
cagtgacactggactt

SEQ ID NO: 32181 - DNA, 16 bp, Artificial Sequence
  synthetic [barcode part1]
cacaccgaaggtcaag

SEQ ID NO: 32182 - DNA, 16 bp, Artificial Sequence
  synthetic [barcode part1]
ccgttgcacctgtagt

SEQ ID NO: 32183 - DNA, 16 bp, Artificial Sequence
  synthetic [barcode part1]
atactggtgataggac

SEQ ID NO: 32184 - DNA, 16 bp, Artificial Sequence
  synthetic [barcode part1]
tgcaacgacttcaggt

SEQ ID NO: 32185 - DNA, 16 bp, Artificial Sequence
  synthetic [barcode part1]
aggtacggacttggtg

SEQ ID NO: 32186 - DNA, 16 bp, Artificial Sequence
  synthetic [barcode part1]
atataaccgtgtggcc

SEQ ID NO: 32187 - DNA, 16 bp, Artificial Sequence
  synthetic [barcode part1]
tgcgcagagtatactc

SEQ ID NO: 32188 - DNA, 16 bp, Artificial Sequence
  synthetic [barcode part1]
aagtgaacgaggcctc

SEQ ID NO: 32189 - DNA, 16 bp, Artificial Sequence
  synthetic [barcode part1]
acttcgcgaacgtctc

SEQ ID NO: 32190 - DNA, 16 bp, Artificial Sequence
  synthetic [barcode part1]
acgtaggatctctgtg

SEQ ID NO: 32191 - DNA, 16 bp, Artificial Sequence
  synthetic [barcode part1]
tatcgcaaggaaggag

SEQ ID NO: 32192 - DNA, 16 bp, Artificial Sequence
  synthetic [barcode part1]
cctcggtactactctt

SEQ ID NO: 32193 - DNA, 16 bp, Artificial Sequence
  synthetic [barcode part1]
ataccagatcaaggac

SEQ ID NO: 32194 - DNA, 16 bp, Artificial Sequence
  synthetic [barcode part1]
gatctcttctccgact

SEQ ID NO: 32195 - DNA, 16 bp, Artificial Sequence
  synthetic [barcode part1]
acgcgattgtgcaact

SEQ ID NO: 32196 - DNA, 16 bp, Artificial Sequence
  synthetic [barcode part1]
agtcacactgattctc

SEQ ID NO: 32197 - DNA, 16 bp, Artificial Sequence
  synthetic [barcode part1]
cgatcgaatcggttgt

SEQ ID NO: 32198 - DNA, 16 bp, Artificial Sequence
  synthetic [barcode part1]
cgcctagattacctcg

SEQ ID NO: 32199 - DNA, 16 bp, Artificial Sequence
  synthetic [barcode part1]
gtacactaggccagag

SEQ ID NO: 32200 - DNA, 16 bp, Artificial Sequence
  synthetic [barcode part1]
gtacctcgactaccac

SEQ ID NO: 32201 - DNA, 16 bp, Artificial Sequence
  synthetic [barcode part1]
ttctcttgatcggcct

SEQ ID NO: 32202 - DNA, 16 bp, Artificial Sequence
  synthetic [barcode part1]
tacgttgacacaccag

SEQ ID NO: 32203 - DNA, 16 bp, Artificial Sequence
  synthetic [barcode part1]
agactgttcgtcgaac

SEQ ID NO: 32204 - DNA, 16 bp, Artificial Sequence
  synthetic [barcode part1]
ttataccgtctggtac

SEQ ID NO: 32205 - DNA, 16 bp, Artificial Sequence
  synthetic [barcode part1]
tgtcgcgtatagtgtg

SEQ ID NO: 32206 - DNA, 16 bp, Artificial Sequence
  synthetic [barcode part1]
gatactcgtaaccacg

SEQ ID NO: 32207 - DNA, 16 bp, Artificial Sequence
  synthetic [barcode part1]
ttactctgattgtgcg

SEQ ID NO: 32208 - DNA, 16 bp, Artificial Sequence
  synthetic [barcode part1]
gtaagtcgactgtacc

SEQ ID NO: 32209 - DNA, 16 bp, Artificial Sequence
  synthetic [barcode part1]
gtacacttattctgcg

SEQ ID NO: 32210 - DNA, 16 bp, Artificial Sequence
  synthetic [barcode part1]
tcttcctcttcggaac

SEQ ID NO: 32211 - DNA, 16 bp, Artificial Sequence
  synthetic [barcode part1]
gtgtatcctgccactg

SEQ ID NO: 32212 - DNA, 16 bp, Artificial Sequence
  synthetic [barcode part1]
ttcgtagtgccacctg

SEQ ID NO: 32213 - DNA, 16 bp, Artificial Sequence
  synthetic [barcode part1]
tgagactcgatcgatc

SEQ ID NO: 32214 - DNA, 16 bp, Artificial Sequence
  synthetic [barcode part1]
cacttagtcctcggtg

SEQ ID NO: 32215 - DNA, 16 bp, Artificial Sequence
  synthetic [barcode part1]
acttacctccagagtt

SEQ ID NO: 32216 - DNA, 16 bp, Artificial Sequence
  synthetic [barcode part1]
gtcgttcacggatctc

SEQ ID NO: 32217 - DNA, 16 bp, Artificial Sequence
  synthetic [barcode part1]
acacggcaagatcgac

SEQ ID NO: 32218 - DNA, 16 bp, Artificial Sequence
  synthetic [barcode part1]
tctgagaccagaactc

SEQ ID NO: 32219 - DNA, 16 bp, Artificial Sequence
  synthetic [barcode part1]
aacggactctgaggtg

SEQ ID NO: 32220 - DNA, 16 bp, Artificial Sequence
  synthetic [barcode part1]
tggagttgtattgcgc

SEQ ID NO: 32221 - DNA, 16 bp, Artificial Sequence
  synthetic [barcode part1]
acgcaccttgttattg

SEQ ID NO: 32222 - DNA, 16 bp, Artificial Sequence
  synthetic [barcode part1]
actcgaatatcactcc

SEQ ID NO: 32223 - DNA, 16 bp, Artificial Sequence
  synthetic [barcode part1]
tcgccactgagtacct

SEQ ID NO: 32224 - DNA, 16 bp, Artificial Sequence
  synthetic [barcode part1]
caatctccgcaaccgt

SEQ ID NO: 32225 - DNA, 16 bp, Artificial Sequence
  synthetic [barcode part1]
gtaatcaggtccttct

SEQ ID NO: 32226 - DNA, 16 bp, Artificial Sequence
  synthetic [barcode part1]
tattgtcaagtgcctc

SEQ ID NO: 32227 - DNA, 16 bp, Artificial Sequence
  synthetic [barcode part1]
ataggtcttgacacgc

SEQ ID NO: 32228 - DNA, 16 bp, Artificial Sequence
  synthetic [barcode part1]
cactaactcctgaccg

SEQ ID NO: 32229 - DNA, 16 bp, Artificial Sequence
  synthetic [barcode part1]
gtaacgttggtatcgc

SEQ ID NO: 32230 - DNA, 16 bp, Artificial Sequence
  synthetic [barcode part1]
gttgccttacttagac

SEQ ID NO: 32231 - DNA, 16 bp, Artificial Sequence
  synthetic [barcode part1]
actaacggtgagatac

SEQ ID NO: 32232 - DNA, 16 bp, Artificial Sequence
  synthetic [barcode part1]
atcggtacctgtgaac

SEQ ID NO: 32233 - DNA, 16 bp, Artificial Sequence
  synthetic [barcode part1]
gtcgtgaccgttcact

SEQ ID NO: 32234 - DNA, 16 bp, Artificial Sequence
  synthetic [barcode part1]
aaccagtgactggttc

SEQ ID NO: 32235 - DNA, 16 bp, Artificial Sequence
  synthetic [barcode part1]
tggtgacggttactgt

SEQ ID NO: 32236 - DNA, 16 bp, Artificial Sequence
  synthetic [barcode part1]
attggaatagtgcgtg

SEQ ID NO: 32237 - DNA, 16 bp, Artificial Sequence
  synthetic [barcode part1]
acaatccgttcttacg

SEQ ID NO: 32238 - DNA, 16 bp, Artificial Sequence
  synthetic [barcode part1]
tgtcgttgtggttact

SEQ ID NO: 32239 - DNA, 16 bp, Artificial Sequence
  synthetic [barcode part1]
gccttgcaacacacct

SEQ ID NO: 32240 - DNA, 16 bp, Artificial Sequence
  synthetic [barcode part1]
cctcagttcgagtacc

SEQ ID NO: 32241 - DNA, 16 bp, Artificial Sequence
  synthetic [barcode part1]
ccgatagatccagtgt

SEQ ID NO: 32242 - DNA, 16 bp, Artificial Sequence
  synthetic [barcode part1]
aggcctcttaagatcg

SEQ ID NO: 32243 - DNA, 16 bp, Artificial Sequence
  synthetic [barcode part1]
gtctgatcggtctaag

SEQ ID NO: 32244 - DNA, 16 bp, Artificial Sequence
  synthetic [barcode part1]
agtgaggtcgagtgtc

SEQ ID NO: 32245 - DNA, 16 bp, Artificial Sequence
  synthetic [barcode part1]
cgataacaaggtacac

SEQ ID NO: 32246 - DNA, 16 bp, Artificial Sequence
  synthetic [barcode part1]
caagtgttcttgttgc

SEQ ID NO: 32247 - DNA, 16 bp, Artificial Sequence
  synthetic [barcode part1]
gaacggttaacgagag

SEQ ID NO: 32248 - DNA, 16 bp, Artificial Sequence
  synthetic [barcode part1]
caagtacttaacgcgc

SEQ ID NO: 32249 - DNA, 16 bp, Artificial Sequence
  synthetic [barcode part1]
cactctctgtaggaag

SEQ ID NO: 32250 - DNA, 16 bp, Artificial Sequence
  synthetic [barcode part1]
tacttctgttgaaccg

SEQ ID NO: 32251 - DNA, 16 bp, Artificial Sequence
  synthetic [barcode part1]
cagagttctggaactc

SEQ ID NO: 32252 - DNA, 16 bp, Artificial Sequence
  synthetic [barcode part1]
cgaattaggaggtact

SEQ ID NO: 32253 - DNA, 16 bp, Artificial Sequence
  synthetic [barcode part1]
gcgaagtgtaacgaag

SEQ ID NO: 32254 - DNA, 16 bp, Artificial Sequence
  synthetic [barcode part1]
attggacctcacgtcc

SEQ ID NO: 32255 - DNA, 16 bp, Artificial Sequence
  synthetic [barcode part1]
tagttggagtcctgac

SEQ ID NO: 32256 - DNA, 16 bp, Artificial Sequence
  synthetic [barcode part1]
gccacttctatctcac

SEQ ID NO: 32257 - DNA, 16 bp, Artificial Sequence
  synthetic [barcode part1]
acgtatcgtaggatag

SEQ ID NO: 32258 - DNA, 16 bp, Artificial Sequence
  synthetic [barcode part1]
gcacgattcttaacct

SEQ ID NO: 32259 - DNA, 16 bp, Artificial Sequence
  synthetic [barcode part1]
ccggttgattacaacg

SEQ ID NO: 32260 - DNA, 16 bp, Artificial Sequence
  synthetic [barcode part1]
cagttctagtcctcct

SEQ ID NO: 32261 - DNA, 16 bp, Artificial Sequence
  synthetic [barcode part1]
aacttgcgttctactg

SEQ ID NO: 32262 - DNA, 16 bp, Artificial Sequence
  synthetic [barcode part1]
aacacaacgttgaacg

SEQ ID NO: 32263 - DNA, 16 bp, Artificial Sequence
  synthetic [barcode part1]
gtacggatagattacg

SEQ ID NO: 32264 - DNA, 16 bp, Artificial Sequence
  synthetic [barcode part1]
gttattacgtacctcg

SEQ ID NO: 32265 - DNA, 16 bp, Artificial Sequence
  synthetic [barcode part1]
cgcctacgtaatactt

SEQ ID NO: 32266 - DNA, 16 bp, Artificial Sequence
  synthetic [barcode part1]
acacgtgccttcttct

SEQ ID NO: 32267 - DNA, 16 bp, Artificial Sequence
  synthetic [barcode part1]
gccactcctacgagtt

SEQ ID NO: 32268 - DNA, 16 bp, Artificial Sequence
  synthetic [barcode part1]
ttacttctctccgacg

SEQ ID NO: 32269 - DNA, 16 bp, Artificial Sequence
  synthetic [barcode part1]
attgcgtgcgtaatcg

SEQ ID NO: 32270 - DNA, 16 bp, Artificial Sequence
  synthetic [barcode part1]
gcaagtggtagacaag

SEQ ID NO: 32271 - DNA, 16 bp, Artificial Sequence
  synthetic [barcode part1]
gacgtgttcgattctt

SEQ ID NO: 32272 - DNA, 16 bp, Artificial Sequence
  synthetic [barcode part1]
cacttatcgccacgac

SEQ ID NO: 32273 - DNA, 16 bp, Artificial Sequence
  synthetic [barcode part1]
ttcgattgcactagtc

SEQ ID NO: 32274 - DNA, 16 bp, Artificial Sequence
  synthetic [barcode part1]
ttccggcgatcgtact

SEQ ID NO: 32275 - DNA, 16 bp, Artificial Sequence
  synthetic [barcode part1]
tctctgacctcaacct

SEQ ID NO: 32276 - DNA, 16 bp, Artificial Sequence
  synthetic [barcode part1]
attcgacaatcgccag

SEQ ID NO: 32277 - DNA, 16 bp, Artificial Sequence
  synthetic [barcode part1]
tggttaagttggccgt

SEQ ID NO: 32278 - DNA, 16 bp, Artificial Sequence
  synthetic [barcode part1]
tctataccttcacgcc

SEQ ID NO: 32279 - DNA, 16 bp, Artificial Sequence
  synthetic [barcode part1]
atacaagaggtcgttg

SEQ ID NO: 32280 - DNA, 16 bp, Artificial Sequence
  synthetic [barcode part1]
ttcgcacaactgttac

SEQ ID NO: 32281 - DNA, 16 bp, Artificial Sequence
  synthetic [barcode part1]
gcgatattgtgtgcac

SEQ ID NO: 32282 - DNA, 16 bp, Artificial Sequence
  synthetic [barcode part1]
gactctcgtatctggc

SEQ ID NO: 32283 - DNA, 16 bp, Artificial Sequence
  synthetic [barcode part1]
gtcagacgtgaggact

SEQ ID NO: 32284 - DNA, 16 bp, Artificial Sequence
  synthetic [barcode part1]
tacaacactgtccact

SEQ ID NO: 32285 - DNA, 16 bp, Artificial Sequence
  synthetic [barcode part1]
cactaactgcgactag

SEQ ID NO: 32286 - DNA, 16 bp, Artificial Sequence
  synthetic [barcode part1]
tacgtgatatcctacc

SEQ ID NO: 32287 - DNA, 16 bp, Artificial Sequence
  synthetic [barcode part1]
gactaggacttaagtg

SEQ ID NO: 32288 - DNA, 16 bp, Artificial Sequence
  synthetic [barcode part1]
tgatcactccaatctg

SEQ ID NO: 32289 - DNA, 16 bp, Artificial Sequence
  synthetic [barcode part1]
aagtagagtctgcctc

SEQ ID NO: 32290 - DNA, 16 bp, Artificial Sequence
  synthetic [barcode part1]
tgtgttgtgtgcaacg

SEQ ID NO: 32291 - DNA, 16 bp, Artificial Sequence
  synthetic [barcode part1]
tctccgatagtcgcac

SEQ ID NO: 32292 - DNA, 16 bp, Artificial Sequence
  synthetic [barcode part1]
ccgtaatacgtgtgtg

SEQ ID NO: 32293 - DNA, 16 bp, Artificial Sequence
  synthetic [barcode part1]
agttctgtctgttcag

SEQ ID NO: 32294 - DNA, 16 bp, Artificial Sequence
  synthetic [barcode part1]
caacgttctgtgacag

SEQ ID NO: 32295 - DNA, 16 bp, Artificial Sequence
  synthetic [barcode part1]
agtggtctaacgacct

SEQ ID NO: 32296 - DNA, 16 bp, Artificial Sequence
  synthetic [barcode part1]
acaacaccgatatcgc

SEQ ID NO: 32297 - DNA, 16 bp, Artificial Sequence
  synthetic [barcode part1]
actgcgacgagattct

SEQ ID NO: 32298 - DNA, 16 bp, Artificial Sequence
  synthetic [barcode part1]
accgagtcgaactgtt

SEQ ID NO: 32299 - DNA, 16 bp, Artificial Sequence
  synthetic [barcode part1]
attgagaaccgcgcag

SEQ ID NO: 32300 - DNA, 16 bp, Artificial Sequence
  synthetic [barcode part1]
ttacaggcactgacac

SEQ ID NO: 32301 - DNA, 16 bp, Artificial Sequence
  synthetic [barcode part1]
ttacgtggagagaccg

SEQ ID NO: 32302 - DNA, 16 bp, Artificial Sequence
  synthetic [barcode part1]
ttctgatagagaccgc

SEQ ID NO: 32303 - DNA, 16 bp, Artificial Sequence
  synthetic [barcode part1]
ttggacgttatcctgt

SEQ ID NO: 32304 - DNA, 16 bp, Artificial Sequence
  synthetic [barcode part1]
tgatagatccactgcg

SEQ ID NO: 32305 - DNA, 16 bp, Artificial Sequence
  synthetic [barcode part1]
gtacagtcgatacacc

SEQ ID NO: 32306 - DNA, 16 bp, Artificial Sequence
  synthetic [barcode part1]
gtgaggtagacctacg

SEQ ID NO: 32307 - DNA, 16 bp, Artificial Sequence
  synthetic [barcode part1]
cagtgtatctcactac

SEQ ID NO: 32308 - DNA, 16 bp, Artificial Sequence
  synthetic [barcode part1]
gtcaacaatccaggtc

SEQ ID NO: 32309 - DNA, 16 bp, Artificial Sequence
  synthetic [barcode part1]
acagtgcaccgattgt

SEQ ID NO: 32310 - DNA, 16 bp, Artificial Sequence
  synthetic [barcode part1]
tgtggtacttacttgc

SEQ ID NO: 32311 - DNA, 16 bp, Artificial Sequence
  synthetic [barcode part1]
cacacgacaaggaatt

SEQ ID NO: 32312 - DNA, 16 bp, Artificial Sequence
  synthetic [barcode part1]
ttccacactagtgact

SEQ ID NO: 32313 - DNA, 16 bp, Artificial Sequence
  synthetic [barcode part1]
agacactacctacgac

SEQ ID NO: 32314 - DNA, 16 bp, Artificial Sequence
  synthetic [barcode part1]
tgtagtgcagacaggc

SEQ ID NO: 32315 - DNA, 16 bp, Artificial Sequence
  synthetic [barcode part1]
cacctaagaaggccag

SEQ ID NO: 32316 - DNA, 16 bp, Artificial Sequence
  synthetic [barcode part1]
taactgaagtcggcct

SEQ ID NO: 32317 - DNA, 16 bp, Artificial Sequence
  synthetic [barcode part1]
cggaattaccacaacc

SEQ ID NO: 32318 - DNA, 16 bp, Artificial Sequence
  synthetic [barcode part1]
gacgagtagacaagtg

SEQ ID NO: 32319 - DNA, 16 bp, Artificial Sequence
  synthetic [barcode part1]
tgtgtgactatcgttc

SEQ ID NO: 32320 - DNA, 16 bp, Artificial Sequence
  synthetic [barcode part1]
aaggacgttatcgaac

SEQ ID NO: 32321 - DNA, 16 bp, Artificial Sequence
  synthetic [barcode part1]
cggttaaggttggttc

SEQ ID NO: 32322 - DNA, 16 bp, Artificial Sequence
  synthetic [barcode part1]
tagaaggtgtaaccgt

SEQ ID NO: 32323 - DNA, 16 bp, Artificial Sequence
  synthetic [barcode part1]
cgtaagttctgttgtc

SEQ ID NO: 32324 - DNA, 16 bp, Artificial Sequence
  synthetic [barcode part1]
gtgacactgtgacact

SEQ ID NO: 32325 - DNA, 16 bp, Artificial Sequence
  synthetic [barcode part1]
taaccaccttagttcg

SEQ ID NO: 32326 - DNA, 16 bp, Artificial Sequence
  synthetic [barcode part1]
atacggtcttcggtcc

SEQ ID NO: 32327 - DNA, 16 bp, Artificial Sequence
  synthetic [barcode part1]
taatcaagtgccgtgc

SEQ ID NO: 32328 - DNA, 16 bp, Artificial Sequence
  synthetic [barcode part1]
gaggaacttacacggc

SEQ ID NO: 32329 - DNA, 16 bp, Artificial Sequence
  synthetic [barcode part1]
aacttcctggcagagt

SEQ ID NO: 32330 - DNA, 16 bp, Artificial Sequence
  synthetic [barcode part1]
tgcgttcaagtgcaac

SEQ ID NO: 32331 - DNA, 16 bp, Artificial Sequence
  synthetic [barcode part1]
aatacgcgtgccaatc

SEQ ID NO: 32332 - DNA, 16 bp, Artificial Sequence
  synthetic [barcode part1]
gcgaatccggtctctt

SEQ ID NO: 32333 - DNA, 16 bp, Artificial Sequence
  synthetic [barcode part1]
atccgtcttacttgcc

SEQ ID NO: 32334 - DNA, 16 bp, Artificial Sequence
  synthetic [barcode part1]
caccagaagaccactt

SEQ ID NO: 32335 - DNA, 16 bp, Artificial Sequence
  synthetic [barcode part1]
acgttaaccggacgtt

SEQ ID NO: 32336 - DNA, 16 bp, Artificial Sequence
  synthetic [barcode part1]
agagtatattgccgag

SEQ ID NO: 32337 - DNA, 16 bp, Artificial Sequence
  synthetic [barcode part1]
ttccgtagactactgt

SEQ ID NO: 32338 - DNA, 16 bp, Artificial Sequence
  synthetic [barcode part1]
gcagtcagactctcct

SEQ ID NO: 32339 - DNA, 16 bp, Artificial Sequence
  synthetic [barcode part1]
gtatcgaccggatatc

SEQ ID NO: 32340 - DNA, 16 bp, Artificial Sequence
  synthetic [barcode part1]
cagacacagaacaact

SEQ ID NO: 32341 - DNA, 16 bp, Artificial Sequence
  synthetic [barcode part1]
atctggagaacggtgc

SEQ ID NO: 32342 - DNA, 16 bp, Artificial Sequence
  synthetic [barcode part1]
gtaaccactagaagac

SEQ ID NO: 32343 - DNA, 16 bp, Artificial Sequence
  synthetic [barcode part1]
tgagtctgtcttgttg

SEQ ID NO: 32344 - DNA, 16 bp, Artificial Sequence
  synthetic [barcode part1]
tggcgacttagtagtc

SEQ ID NO: 32345 - DNA, 16 bp, Artificial Sequence
  synthetic [barcode part1]
ttgcggagacgacagt

SEQ ID NO: 32346 - DNA, 16 bp, Artificial Sequence
  synthetic [barcode part1]
aaggacctcctaatcg

SEQ ID NO: 32347 - DNA, 16 bp, Artificial Sequence
  synthetic [barcode part1]
cgaaccgagagtacac

SEQ ID NO: 32348 - DNA, 16 bp, Artificial Sequence
  synthetic [barcode part1]
tcgtcgcacaggtctt

SEQ ID NO: 32349 - DNA, 16 bp, Artificial Sequence
  synthetic [barcode part1]
taggtacgacttgtgc

SEQ ID NO: 32350 - DNA, 16 bp, Artificial Sequence
  synthetic [barcode part1]
aataactcgactcggc

SEQ ID NO: 32351 - DNA, 16 bp, Artificial Sequence
  synthetic [barcode part1]
ccaggtatatcgttct

SEQ ID NO: 32352 - DNA, 16 bp, Artificial Sequence
  synthetic [barcode part1]
ccgattctactctgtc

SEQ ID NO: 32353 - DNA, 16 bp, Artificial Sequence
  synthetic [barcode part1]
tcaacagagtgactcc

SEQ ID NO: 32354 - DNA, 16 bp, Artificial Sequence
  synthetic [barcode part1]
cagacgaacttatccg

SEQ ID NO: 32355 - DNA, 16 bp, Artificial Sequence
  synthetic [barcode part1]
aacacgtgttgacacc

SEQ ID NO: 32356 - DNA, 16 bp, Artificial Sequence
  synthetic [barcode part1]
tataaggcggtctaag

SEQ ID NO: 32357 - DNA, 16 bp, Artificial Sequence
  synthetic [barcode part1]
gagtactaacgaggcc

SEQ ID NO: 32358 - DNA, 16 bp, Artificial Sequence
  synthetic [barcode part1]
actgtactcttcaacg

SEQ ID NO: 32359 - DNA, 16 bp, Artificial Sequence
  synthetic [barcode part1]
gccacaggaacagatc

SEQ ID NO: 32360 - DNA, 16 bp, Artificial Sequence
  synthetic [barcode part1]
gagatctacgagtggc

SEQ ID NO: 32361 - DNA, 16 bp, Artificial Sequence
  synthetic [barcode part1]
tcggcgaataggaacc

SEQ ID NO: 32362 - DNA, 16 bp, Artificial Sequence
  synthetic [barcode part1]
tcgtgtaacgcgttag

SEQ ID NO: 32363 - DNA, 16 bp, Artificial Sequence
  synthetic [barcode part1]
gttgcaattgttcgtc

SEQ ID NO: 32364 - DNA, 16 bp, Artificial Sequence
  synthetic [barcode part1]
gcgatagacaaggtag

SEQ ID NO: 32365 - DNA, 16 bp, Artificial Sequence
  synthetic [barcode part1]
tacacgtgtaccacag

SEQ ID NO: 32366 - DNA, 16 bp, Artificial Sequence
  synthetic [barcode part1]
tctggttacacactgt

SEQ ID NO: 32367 - DNA, 16 bp, Artificial Sequence
  synthetic [barcode part1]
agtacaccacacagtc

SEQ ID NO: 32368 - DNA, 16 bp, Artificial Sequence
  synthetic [barcode part1]
gccaacaggactaggt

SEQ ID NO: 32369 - DNA, 16 bp, Artificial Sequence
  synthetic [barcode part1]
cgtcgttcttgatctc

SEQ ID NO: 32370 - DNA, 16 bp, Artificial Sequence
  synthetic [barcode part1]
tggacgaagacaagtg

SEQ ID NO: 32371 - DNA, 16 bp, Artificial Sequence
  synthetic [barcode part1]
cggttccgcgttaact

SEQ ID NO: 32372 - DNA, 16 bp, Artificial Sequence
  synthetic [barcode part1]
ccacctgtgttcactt

SEQ ID NO: 32373 - DNA, 16 bp, Artificial Sequence
  synthetic [barcode part1]
cctatatccggcagtc

SEQ ID NO: 32374 - DNA, 16 bp, Artificial Sequence
  synthetic [barcode part1]
atcttgttaggaggcc

SEQ ID NO: 32375 - DNA, 16 bp, Artificial Sequence
  synthetic [barcode part1]
tcctcgaattacacac

SEQ ID NO: 32376 - DNA, 16 bp, Artificial Sequence
  synthetic [barcode part1]
gattcttctgaacgtc

SEQ ID NO: 32377 - DNA, 16 bp, Artificial Sequence
  synthetic [barcode part1]
ataactatcggccttc

SEQ ID NO: 32378 - DNA, 16 bp, Artificial Sequence
  synthetic [barcode part1]
gttctgcgcaattatc

SEQ ID NO: 32379 - DNA, 16 bp, Artificial Sequence
  synthetic [barcode part1]
cgcctgttgaataggt

SEQ ID NO: 32380 - DNA, 16 bp, Artificial Sequence
  synthetic [barcode part1]
agacaggcactgtgac

SEQ ID NO: 32381 - DNA, 16 bp, Artificial Sequence
  synthetic [barcode part1]
accgtaagtcttggac

SEQ ID NO: 32382 - DNA, 16 bp, Artificial Sequence
  synthetic [barcode part1]
tattaccgttcctcgc

SEQ ID NO: 32383 - DNA, 16 bp, Artificial Sequence
  synthetic [barcode part1]
tgtggactctgccgtt

SEQ ID NO: 32384 - DNA, 16 bp, Artificial Sequence
  synthetic [barcode part1]
atagactcagtcctct

SEQ ID NO: 32385 - DNA, 16 bp, Artificial Sequence
  synthetic [barcode part1]
tgtcagattgtacctc

SEQ ID NO: 32386 - DNA, 16 bp, Artificial Sequence
  synthetic [barcode part1]
acgttagtgtaggtcc

SEQ ID NO: 32387 - DNA, 16 bp, Artificial Sequence
  synthetic [barcode part1]
tcttcaatctcggtcc

SEQ ID NO: 32388 - DNA, 16 bp, Artificial Sequence
  synthetic [barcode part1]
gcaggaataacttgac

SEQ ID NO: 32389 - DNA, 16 bp, Artificial Sequence
  synthetic [barcode part1]
tcacgtacaaccgtag

SEQ ID NO: 32390 - DNA, 16 bp, Artificial Sequence
  synthetic [barcode part1]
aggacgtctagtggtg

SEQ ID NO: 32391 - DNA, 16 bp, Artificial Sequence
  synthetic [barcode part1]
gaagaatcggaggatc

SEQ ID NO: 32392 - DNA, 16 bp, Artificial Sequence
  synthetic [barcode part1]
gacagtctgcaggagt

SEQ ID NO: 32393 - DNA, 16 bp, Artificial Sequence
  synthetic [barcode part1]
atccgtcttcaagatc

SEQ ID NO: 32394 - DNA, 16 bp, Artificial Sequence
  synthetic [barcode part1]
cgaagttattggtcgc

SEQ ID NO: 32395 - DNA, 16 bp, Artificial Sequence
  synthetic [barcode part1]
tgtagtctcagacgtg

SEQ ID NO: 32396 - DNA, 16 bp, Artificial Sequence
  synthetic [barcode part1]
gcggaatataggcctg

SEQ ID NO: 32397 - DNA, 16 bp, Artificial Sequence
  synthetic [barcode part1]
cagtgcgtcctactac

SEQ ID NO: 32398 - DNA, 16 bp, Artificial Sequence
  synthetic [barcode part1]
cgtctcaggacttgtc

SEQ ID NO: 32399 - DNA, 16 bp, Artificial Sequence
  synthetic [barcode part1]
gcaggaagattattgc

SEQ ID NO: 32400 - DNA, 16 bp, Artificial Sequence
  synthetic [barcode part1]
gtgtgcacaacgttgt

SEQ ID NO: 32401 - DNA, 16 bp, Artificial Sequence
  synthetic [barcode part1]
tattcctccagtggcg

SEQ ID NO: 32402 - DNA, 16 bp, Artificial Sequence
  synthetic [barcode part1]
cgcggattccgttatc

SEQ ID NO: 32403 - DNA, 16 bp, Artificial Sequence
  synthetic [barcode part1]
tcacactcggattact

SEQ ID NO: 32404 - DNA, 16 bp, Artificial Sequence
  synthetic [barcode part1]
ttacgttgttcctgcc

SEQ ID NO: 32405 - DNA, 16 bp, Artificial Sequence
  synthetic [barcode part1]
tagaccggtatctctt

SEQ ID NO: 32406 - DNA, 16 bp, Artificial Sequence
  synthetic [barcode part1]
ttattgacgcaccttg

SEQ ID NO: 32407 - DNA, 16 bp, Artificial Sequence
  synthetic [barcode part1]
aataccacctcgaggt

SEQ ID NO: 32408 - DNA, 16 bp, Artificial Sequence
  synthetic [barcode part1]
cggatcacttccacgt

SEQ ID NO: 32409 - DNA, 16 bp, Artificial Sequence
  synthetic [barcode part1]
gtaggttcacaggttc

SEQ ID NO: 32410 - DNA, 16 bp, Artificial Sequence
  synthetic [barcode part1]
ttcgccgttggacgtt

SEQ ID NO: 32411 - DNA, 16 bp, Artificial Sequence
  synthetic [barcode part1]
ccgcctcaagaattag

SEQ ID NO: 32412 - DNA, 16 bp, Artificial Sequence
  synthetic [barcode part1]
aacaagtcgttcgtcg

SEQ ID NO: 32413 - DNA, 16 bp, Artificial Sequence
  synthetic [barcode part1]
gtacagtgatcttctc

SEQ ID NO: 32414 - DNA, 16 bp, Artificial Sequence
  synthetic [barcode part1]
ccaattgccagaactg

SEQ ID NO: 32415 - DNA, 16 bp, Artificial Sequence
  synthetic [barcode part1]
aggtaagttcgtccgt

SEQ ID NO: 32416 - DNA, 16 bp, Artificial Sequence
  synthetic [barcode part1]
tcactatccgtgaatc

SEQ ID NO: 32417 - DNA, 16 bp, Artificial Sequence
  synthetic [barcode part1]
caaggtcctctctctt

SEQ ID NO: 32418 - DNA, 16 bp, Artificial Sequence
  synthetic [barcode part1]
tctatcaaccgtcctc

SEQ ID NO: 32419 - DNA, 16 bp, Artificial Sequence
  synthetic [barcode part1]
accagacaggtcactt

SEQ ID NO: 32420 - DNA, 16 bp, Artificial Sequence
  synthetic [barcode part1]
cgtctcgccacagatt

SEQ ID NO: 32421 - DNA, 16 bp, Artificial Sequence
  synthetic [barcode part1]
tccgaatcggattcag

SEQ ID NO: 32422 - DNA, 16 bp, Artificial Sequence
  synthetic [barcode part1]
aacgcaccacgcaatt

SEQ ID NO: 32423 - DNA, 16 bp, Artificial Sequence
  synthetic [barcode part1]
acacgaggaatacgag

SEQ ID NO: 32424 - DNA, 16 bp, Artificial Sequence
  synthetic [barcode part1]
tgacggtcttccgtgt

SEQ ID NO: 32425 - DNA, 16 bp, Artificial Sequence
  synthetic [barcode part1]
tatccgaatacgaccg

SEQ ID NO: 32426 - DNA, 16 bp, Artificial Sequence
  synthetic [barcode part1]
cgatcaggatcagtct

SEQ ID NO: 32427 - DNA, 16 bp, Artificial Sequence
  synthetic [barcode part1]
gagacagttgtaggcc

SEQ ID NO: 32428 - DNA, 16 bp, Artificial Sequence
  synthetic [barcode part1]
tggtgagagtgaagtg

SEQ ID NO: 32429 - DNA, 16 bp, Artificial Sequence
  synthetic [barcode part1]
acctagacactattcc

SEQ ID NO: 32430 - DNA, 16 bp, Artificial Sequence
  synthetic [barcode part1]
cagttgactggaatcc

SEQ ID NO: 32431 - DNA, 16 bp, Artificial Sequence
  synthetic [barcode part1]
tggtgtaggaacgacc

SEQ ID NO: 32432 - DNA, 16 bp, Artificial Sequence
  synthetic [barcode part1]
cgactctgtatcaatc

SEQ ID NO: 32433 - DNA, 16 bp, Artificial Sequence
  synthetic [barcode part1]
ttgcggcagaattctg

SEQ ID NO: 32434 - DNA, 16 bp, Artificial Sequence
  synthetic [barcode part1]
gacctcttcctgttac

SEQ ID NO: 32435 - DNA, 16 bp, Artificial Sequence
  synthetic [barcode part1]
tgatcttgcgccagtc

SEQ ID NO: 32436 - DNA, 16 bp, Artificial Sequence
  synthetic [barcode part1]
actcgcgacacttaag

SEQ ID NO: 32437 - DNA, 16 bp, Artificial Sequence
  synthetic [barcode part1]
taaccaacgcgtgtgt

SEQ ID NO: 32438 - DNA, 16 bp, Artificial Sequence
  synthetic [barcode part1]
ttaacaatacctccgc

SEQ ID NO: 32439 - DNA, 16 bp, Artificial Sequence
  synthetic [barcode part1]
cgaaggtcaaggatag

SEQ ID NO: 32440 - DNA, 16 bp, Artificial Sequence
  synthetic [barcode part1]
tgataactcctcgtgt

SEQ ID NO: 32441 - DNA, 16 bp, Artificial Sequence
  synthetic [barcode part1]
gtcggtctagtgttag

SEQ ID NO: 32442 - DNA, 16 bp, Artificial Sequence
  synthetic [barcode part1]
tgcaagttctgtcgcc

SEQ ID NO: 32443 - DNA, 16 bp, Artificial Sequence
  synthetic [barcode part1]
tccacctcggaatctg

SEQ ID NO: 32444 - DNA, 16 bp, Artificial Sequence
  synthetic [barcode part1]
cgcacaagtctgagtt

SEQ ID NO: 32445 - DNA, 16 bp, Artificial Sequence
  synthetic [barcode part1]
tatctggactagagag

SEQ ID NO: 32446 - DNA, 16 bp, Artificial Sequence
  synthetic [barcode part1]
tctgtacaaccgttgt

SEQ ID NO: 32447 - DNA, 16 bp, Artificial Sequence
  synthetic [barcode part1]
gcactatctgcctacg

SEQ ID NO: 32448 - DNA, 16 bp, Artificial Sequence
  synthetic [barcode part1]
gcagacactgcagtag

SEQ ID NO: 32449 - DNA, 16 bp, Artificial Sequence
  synthetic [barcode part1]
tgacgacaactcgact

SEQ ID NO: 32450 - DNA, 16 bp, Artificial Sequence
  synthetic [barcode part1]
tattagacgccagacc

SEQ ID NO: 32451 - DNA, 16 bp, Artificial Sequence
  synthetic [barcode part1]
ttgcagtctagagtcg

SEQ ID NO: 32452 - DNA, 16 bp, Artificial Sequence
  synthetic [barcode part1]
tccactcctacttgtg

SEQ ID NO: 32453 - DNA, 16 bp, Artificial Sequence
  synthetic [barcode part1]
aacctaccggatatcg

SEQ ID NO: 32454 - DNA, 16 bp, Artificial Sequence
  synthetic [barcode part1]
tgcagagtgtaggaag

SEQ ID NO: 32455 - DNA, 16 bp, Artificial Sequence
  synthetic [barcode part1]
agacctgtgagagatt

SEQ ID NO: 32456 - DNA, 16 bp, Artificial Sequence
  synthetic [barcode part1]
atcgcctgacagaatc

SEQ ID NO: 32457 - DNA, 16 bp, Artificial Sequence
  synthetic [barcode part1]
tataagtccgcaggtc

SEQ ID NO: 32458 - DNA, 16 bp, Artificial Sequence
  synthetic [barcode part1]
ttggttctgaactcgt

SEQ ID NO: 32459 - DNA, 16 bp, Artificial Sequence
  synthetic [barcode part1]
tactactccgtcgttc

SEQ ID NO: 32460 - DNA, 16 bp, Artificial Sequence
  synthetic [barcode part1]
atcacactcagacacg

SEQ ID NO: 32461 - DNA, 16 bp, Artificial Sequence
  synthetic [barcode part1]
tgaactcgtcttgttg

SEQ ID NO: 32462 - DNA, 16 bp, Artificial Sequence
  synthetic [barcode part1]
gaattcgactcttcac

SEQ ID NO: 32463 - DNA, 16 bp, Artificial Sequence
  synthetic [barcode part1]
tacaggtcagagtaac

SEQ ID NO: 32464 - DNA, 16 bp, Artificial Sequence
  synthetic [barcode part1]
tgtctcaactccacct

SEQ ID NO: 32465 - DNA, 16 bp, Artificial Sequence
  synthetic [barcode part1]
gttctaccgttaacgt

SEQ ID NO: 32466 - DNA, 16 bp, Artificial Sequence
  synthetic [barcode part1]
tctccacacttctacg

SEQ ID NO: 32467 - DNA, 16 bp, Artificial Sequence
  synthetic [barcode part1]
taagaacctcggtaag

SEQ ID NO: 32468 - DNA, 16 bp, Artificial Sequence
  synthetic [barcode part1]
tagtagtcacggaagt

SEQ ID NO: 32469 - DNA, 16 bp, Artificial Sequence
  synthetic [barcode part1]
acgttgacgacgagac

SEQ ID NO: 32470 - DNA, 16 bp, Artificial Sequence
  synthetic [barcode part1]
gccgaacggattattc

SEQ ID NO: 32471 - DNA, 16 bp, Artificial Sequence
  synthetic [barcode part1]
cagtacttggaacctg

SEQ ID NO: 32472 - DNA, 16 bp, Artificial Sequence
  synthetic [barcode part1]
aaccagtctgaccaac

SEQ ID NO: 32473 - DNA, 16 bp, Artificial Sequence
  synthetic [barcode part1]
tatcctatccaagtgc

SEQ ID NO: 32474 - DNA, 16 bp, Artificial Sequence
  synthetic [barcode part1]
tattggaggtacaggt

SEQ ID NO: 32475 - DNA, 16 bp, Artificial Sequence
  synthetic [barcode part1]
tgtcagtcagtgtacg

SEQ ID NO: 32476 - DNA, 16 bp, Artificial Sequence
  synthetic [barcode part1]
agtgccagttagtcgt

SEQ ID NO: 32477 - DNA, 16 bp, Artificial Sequence
  synthetic [barcode part1]
gttcgagtccactatt

SEQ ID NO: 32478 - DNA, 16 bp, Artificial Sequence
  synthetic [barcode part1]
aacgcgaggtgatctg

SEQ ID NO: 32479 - DNA, 16 bp, Artificial Sequence
  synthetic [barcode part1]
gcgaagacaacaattc

SEQ ID NO: 32480 - DNA, 16 bp, Artificial Sequence
  synthetic [barcode part1]
aagtagtatacggtcg

SEQ ID NO: 32481 - DNA, 16 bp, Artificial Sequence
  synthetic [barcode part1]
tattgtcgtctaggtc

SEQ ID NO: 32482 - DNA, 16 bp, Artificial Sequence
  synthetic [barcode part1]
ttcacttccgtaacag

SEQ ID NO: 32483 - DNA, 16 bp, Artificial Sequence
  synthetic [barcode part1]
cgattgtctcgatccg

SEQ ID NO: 32484 - DNA, 16 bp, Artificial Sequence
  synthetic [barcode part1]
cactggcgttatacag

SEQ ID NO: 32485 - DNA, 16 bp, Artificial Sequence
  synthetic [barcode part1]
atacacgccagaactc

SEQ ID NO: 32486 - DNA, 16 bp, Artificial Sequence
  synthetic [barcode part1]
cacagttcttcgccag

SEQ ID NO: 32487 - DNA, 16 bp, Artificial Sequence
  synthetic [barcode part1]
accacgacctggaatt

SEQ ID NO: 32488 - DNA, 16 bp, Artificial Sequence
  synthetic [barcode part1]
tggttactccggttcg

SEQ ID NO: 32489 - DNA, 16 bp, Artificial Sequence
  synthetic [barcode part1]
gtgtgacctccttggt

SEQ ID NO: 32490 - DNA, 16 bp, Artificial Sequence
  synthetic [barcode part1]
atagaaggagacgcac

SEQ ID NO: 32491 - DNA, 16 bp, Artificial Sequence
  synthetic [barcode part1]
tatattgccgattccg

SEQ ID NO: 32492 - DNA, 16 bp, Artificial Sequence
  synthetic [barcode part1]
tccaaggaactccagt

SEQ ID NO: 32493 - DNA, 16 bp, Artificial Sequence
  synthetic [barcode part1]
ttctgcagactgccgt

SEQ ID NO: 32494 - DNA, 16 bp, Artificial Sequence
  synthetic [barcode part1]
aaccgcgatatcaacc

SEQ ID NO: 32495 - DNA, 16 bp, Artificial Sequence
  synthetic [barcode part1]
tgatagagtctcgtcg

SEQ ID NO: 32496 - DNA, 16 bp, Artificial Sequence
  synthetic [barcode part1]
tagacacgtcacctcc

SEQ ID NO: 32497 - DNA, 16 bp, Artificial Sequence
  synthetic [barcode part1]
tgagagactggtcctt

SEQ ID NO: 32498 - DNA, 16 bp, Artificial Sequence
  synthetic [barcode part1]
actaagactccgatcg

SEQ ID NO: 32499 - DNA, 16 bp, Artificial Sequence
  synthetic [barcode part1]
cgcgtcaatattggtg

SEQ ID NO: 32500 - DNA, 16 bp, Artificial Sequence
  synthetic [barcode part1]
cctgttgttggcgtac

SEQ ID NO: 32501 - DNA, 16 bp, Artificial Sequence
  synthetic [barcode part1]
cggactcgatattcag

SEQ ID NO: 32502 - DNA, 16 bp, Artificial Sequence
  synthetic [barcode part1]
tcttcaacacgatcac

SEQ ID NO: 32503 - DNA, 16 bp, Artificial Sequence
  synthetic [barcode part1]
tcgtaaggcgattacc

SEQ ID NO: 32504 - DNA, 16 bp, Artificial Sequence
  synthetic [barcode part1]
tgaacctacaagtccg

SEQ ID NO: 32505 - DNA, 16 bp, Artificial Sequence
  synthetic [barcode part1]
acggtattagtgccac

SEQ ID NO: 32506 - DNA, 16 bp, Artificial Sequence
  synthetic [barcode part1]
tcgattgccaggattg

SEQ ID NO: 32507 - DNA, 16 bp, Artificial Sequence
  synthetic [barcode part1]
ccaatagactcagtgc

SEQ ID NO: 32508 - DNA, 16 bp, Artificial Sequence
  synthetic [barcode part1]
tgtatccgtggaggtt

SEQ ID NO: 32509 - DNA, 16 bp, Artificial Sequence
  synthetic [barcode part1]
gtcttgttccgacctt

SEQ ID NO: 32510 - DNA, 16 bp, Artificial Sequence
  synthetic [barcode part1]
tgacctcagaatcgac

SEQ ID NO: 32511 - DNA, 16 bp, Artificial Sequence
  synthetic [barcode part1]
attagaccttacgcct

SEQ ID NO: 32512 - DNA, 16 bp, Artificial Sequence
  synthetic [barcode part1]
caactcttcggtctct

SEQ ID NO: 32513 - DNA, 16 bp, Artificial Sequence
  synthetic [barcode part1]
acgcaattaacgcacc

SEQ ID NO: 32514 - DNA, 16 bp, Artificial Sequence
  synthetic [barcode part1]
ttatcgcggcggaatt

SEQ ID NO: 32515 - DNA, 16 bp, Artificial Sequence
  synthetic [barcode part1]
cgcctgttcacaacgt

SEQ ID NO: 32516 - DNA, 16 bp, Artificial Sequence
  synthetic [barcode part1]
gaacacctggaacggt

SEQ ID NO: 32517 - DNA, 16 bp, Artificial Sequence
  synthetic [barcode part1]
atacaagtaggttgcg

SEQ ID NO: 32518 - DNA, 16 bp, Artificial Sequence
  synthetic [barcode part1]
gccttacttcagtctc

SEQ ID NO: 32519 - DNA, 16 bp, Artificial Sequence
  synthetic [barcode part1]
gcgactcgttcttgtg

SEQ ID NO: 32520 - DNA, 16 bp, Artificial Sequence
  synthetic [barcode part1]
actacgttcagtgcag

SEQ ID NO: 32521 - DNA, 16 bp, Artificial Sequence
  synthetic [barcode part1]
atcctcgtatccttgc

SEQ ID NO: 32522 - DNA, 16 bp, Artificial Sequence
  synthetic [barcode part1]
tgtggtgcgcctactt

SEQ ID NO: 32523 - DNA, 16 bp, Artificial Sequence
  synthetic [barcode part1]
atcgcgacggaattct

SEQ ID NO: 32524 - DNA, 16 bp, Artificial Sequence
  synthetic [barcode part1]
gactggcctaactaac

SEQ ID NO: 32525 - DNA, 16 bp, Artificial Sequence
  synthetic [barcode part1]
cgttatctgagtctgt

SEQ ID NO: 32526 - DNA, 16 bp, Artificial Sequence
  synthetic [barcode part1]
aataatatcgcaggcg

SEQ ID NO: 32527 - DNA, 16 bp, Artificial Sequence
  synthetic [barcode part1]
aacgtgtcctcaattc

SEQ ID NO: 32528 - DNA, 16 bp, Artificial Sequence
  synthetic [barcode part1]
tacgcctattcttgcc

SEQ ID NO: 32529 - DNA, 16 bp, Artificial Sequence
  synthetic [barcode part1]
tgttggttggtcacag

SEQ ID NO: 32530 - DNA, 16 bp, Artificial Sequence
  synthetic [barcode part1]
taacagacaagtgtcg

SEQ ID NO: 32531 - DNA, 16 bp, Artificial Sequence
  synthetic [barcode part1]
ttcgaacgagttagag

SEQ ID NO: 32532 - DNA, 16 bp, Artificial Sequence
  synthetic [barcode part1]
ttatattaggcgcggc

SEQ ID NO: 32533 - DNA, 16 bp, Artificial Sequence
  synthetic [barcode part1]
agttgtcgttctcgcg

SEQ ID NO: 32534 - DNA, 16 bp, Artificial Sequence
  synthetic [barcode part1]
tgttacgtcagtcgag

SEQ ID NO: 32535 - DNA, 16 bp, Artificial Sequence
  synthetic [barcode part1]
tactgacacgttggtg

SEQ ID NO: 32536 - DNA, 16 bp, Artificial Sequence
  synthetic [barcode part1]
cgttgtcggtgtgttc

SEQ ID NO: 32537 - DNA, 16 bp, Artificial Sequence
  synthetic [barcode part1]
acgaattggcctgtgt

SEQ ID NO: 32538 - DNA, 16 bp, Artificial Sequence
  synthetic [barcode part1]
tgttcttcggcctgag

SEQ ID NO: 32539 - DNA, 16 bp, Artificial Sequence
  synthetic [barcode part1]
cctcagttcttcaacc

SEQ ID NO: 32540 - DNA, 16 bp, Artificial Sequence
  synthetic [barcode part1]
caatcgttctggtccg

SEQ ID NO: 32541 - DNA, 16 bp, Artificial Sequence
  synthetic [barcode part1]
tgagtcaagtctgacc

SEQ ID NO: 32542 - DNA, 16 bp, Artificial Sequence
  synthetic [barcode part1]
aatcggtgtatcgcac

SEQ ID NO: 32543 - DNA, 16 bp, Artificial Sequence
  synthetic [barcode part1]
aattgatacgcacgcc

SEQ ID NO: 32544 - DNA, 16 bp, Artificial Sequence
  synthetic [barcode part1]
ttccgatccggacgtt

SEQ ID NO: 32545 - DNA, 16 bp, Artificial Sequence
  synthetic [barcode part1]
attgtcgacgcggaag

SEQ ID NO: 32546 - DNA, 16 bp, Artificial Sequence
  synthetic [barcode part1]
gacagaccaagacctg

SEQ ID NO: 32547 - DNA, 16 bp, Artificial Sequence
  synthetic [barcode part1]
aaggacaacttgacgt

SEQ ID NO: 32548 - DNA, 16 bp, Artificial Sequence
  synthetic [barcode part1]
acctgaagtggacttc

SEQ ID NO: 32549 - DNA, 16 bp, Artificial Sequence
  synthetic [barcode part1]
taatacaccttcggtc

SEQ ID NO: 32550 - DNA, 16 bp, Artificial Sequence
  synthetic [barcode part1]
cgacaagaggtgatag

SEQ ID NO: 32551 - DNA, 16 bp, Artificial Sequence
  synthetic [barcode part1]
actaacgccgtcactc

SEQ ID NO: 32552 - DNA, 16 bp, Artificial Sequence
  synthetic [barcode part1]
caaggagtggtgtgtc

SEQ ID NO: 32553 - DNA, 16 bp, Artificial Sequence
  synthetic [barcode part1]
tagtcacctgttactg

SEQ ID NO: 32554 - DNA, 16 bp, Artificial Sequence
  synthetic [barcode part1]
gagtagaggacggatt

SEQ ID NO: 32555 - DNA, 16 bp, Artificial Sequence
  synthetic [barcode part1]
gacggaatagtgagac

SEQ ID NO: 32556 - DNA, 16 bp, Artificial Sequence
  synthetic [barcode part1]
tgccttgcctattgtc

SEQ ID NO: 32557 - DNA, 16 bp, Artificial Sequence
  synthetic [barcode part1]
gtcgagattcctcaag

SEQ ID NO: 32558 - DNA, 16 bp, Artificial Sequence
  synthetic [barcode part1]
ttgcagttggtcagtg

SEQ ID NO: 32559 - DNA, 16 bp, Artificial Sequence
  synthetic [barcode part1]
ttgattacgcgacgtg

SEQ ID NO: 32560 - DNA, 16 bp, Artificial Sequence
  synthetic [barcode part1]
tctctaatcctggtcc

SEQ ID NO: 32561 - DNA, 16 bp, Artificial Sequence
  synthetic [barcode part1]
gcactccaagatacgt

SEQ ID NO: 32562 - DNA, 16 bp, Artificial Sequence
  synthetic [barcode part1]
tacggttccaagtgtg

SEQ ID NO: 32563 - DNA, 16 bp, Artificial Sequence
  synthetic [barcode part1]
ttaacggtgtcagacc

SEQ ID NO: 32564 - DNA, 16 bp, Artificial Sequence
  synthetic [barcode part1]
cgaactaccttcgcac

SEQ ID NO: 32565 - DNA, 16 bp, Artificial Sequence
  synthetic [barcode part1]
cactgagacgattcgt

SEQ ID NO: 32566 - DNA, 16 bp, Artificial Sequence
  synthetic [barcode part1]
tggcgaaggtactcag

SEQ ID NO: 32567 - DNA, 16 bp, Artificial Sequence
  synthetic [barcode part1]
gaaggtaagtgacctt

SEQ ID NO: 32568 - DNA, 16 bp, Artificial Sequence
  synthetic [barcode part1]
ccaccactacttaagt

SEQ ID NO: 32569 - DNA, 16 bp, Artificial Sequence
  synthetic [barcode part1]
ccaagtattgcaggtc

SEQ ID NO: 32570 - DNA, 16 bp, Artificial Sequence
  synthetic [barcode part1]
gtgcaattctctcggc

SEQ ID NO: 32571 - DNA, 16 bp, Artificial Sequence
  synthetic [barcode part1]
ttgtcacaggcctatt

SEQ ID NO: 32572 - DNA, 16 bp, Artificial Sequence
  synthetic [barcode part1]
gacgtacagaatcagt

SEQ ID NO: 32573 - DNA, 16 bp, Artificial Sequence
  synthetic [barcode part1]
tacaggttgaggtaac

SEQ ID NO: 32574 - DNA, 16 bp, Artificial Sequence
  synthetic [barcode part1]
cgtgaatatccacgac

SEQ ID NO: 32575 - DNA, 16 bp, Artificial Sequence
  synthetic [barcode part1]
gaagttcctacctatc

SEQ ID NO: 32576 - DNA, 16 bp, Artificial Sequence
  synthetic [barcode part1]
cgtggtctgattcctg

SEQ ID NO: 32577 - DNA, 16 bp, Artificial Sequence
  synthetic [barcode part1]
taacggtccttgcgtc

SEQ ID NO: 32578 - DNA, 16 bp, Artificial Sequence
  synthetic [barcode part1]
actactcgtggatctt

SEQ ID NO: 32579 - DNA, 16 bp, Artificial Sequence
  synthetic [barcode part1]
cgaaggaatcacacgc

SEQ ID NO: 32580 - DNA, 16 bp, Artificial Sequence
  synthetic [barcode part1]
gattccttggcagagt

SEQ ID NO: 32581 - DNA, 16 bp, Artificial Sequence
  synthetic [barcode part1]
ttgtgaactgttgcct

SEQ ID NO: 32582 - DNA, 16 bp, Artificial Sequence
  synthetic [barcode part1]
gaatcgtcacttccgc

SEQ ID NO: 32583 - DNA, 16 bp, Artificial Sequence
  synthetic [barcode part1]
gtggtcctatcaagtg

SEQ ID NO: 32584 - DNA, 16 bp, Artificial Sequence
  synthetic [barcode part1]
gacgtgcgtatatcac

SEQ ID NO: 32585 - DNA, 16 bp, Artificial Sequence
  synthetic [barcode part1]
accggataggtatagt

SEQ ID NO: 32586 - DNA, 16 bp, Artificial Sequence
  synthetic [barcode part1]
cggcgcacaattcctt

SEQ ID NO: 32587 - DNA, 16 bp, Artificial Sequence
  synthetic [barcode part1]
cacaactccttcgacg

SEQ ID NO: 32588 - DNA, 16 bp, Artificial Sequence
  synthetic [barcode part1]
cgtagtgacttgttct

SEQ ID NO: 32589 - DNA, 16 bp, Artificial Sequence
  synthetic [barcode part1]
tgatcaacggtcgact

SEQ ID NO: 32590 - DNA, 16 bp, Artificial Sequence
  synthetic [barcode part1]
tattctggtggtaggc

SEQ ID NO: 32591 - DNA, 16 bp, Artificial Sequence
  synthetic [barcode part1]
gaccaatcggttgatc

SEQ ID NO: 32592 - DNA, 16 bp, Artificial Sequence
  synthetic [barcode part1]
tatcctagaattcgcc

SEQ ID NO: 32593 - DNA, 16 bp, Artificial Sequence
  synthetic [barcode part1]
gtcaccgtcaataacg

SEQ ID NO: 32594 - DNA, 16 bp, Artificial Sequence
  synthetic [barcode part1]
tagaccggtcgaactt

SEQ ID NO: 32595 - DNA, 16 bp, Artificial Sequence
  synthetic [barcode part1]
ataggccaccactcct

SEQ ID NO: 32596 - DNA, 16 bp, Artificial Sequence
  synthetic [barcode part1]
gtggtaccaactgact

SEQ ID NO: 32597 - DNA, 16 bp, Artificial Sequence
  synthetic [barcode part1]
gtccaatccttacgcg

SEQ ID NO: 32598 - DNA, 16 bp, Artificial Sequence
  synthetic [barcode part1]
ttatcgtctgttccgc

SEQ ID NO: 32599 - DNA, 16 bp, Artificial Sequence
  synthetic [barcode part1]
cgcagaacaacttaag

SEQ ID NO: 32600 - DNA, 16 bp, Artificial Sequence
  synthetic [barcode part1]
tccttctccggaattc

SEQ ID NO: 32601 - DNA, 16 bp, Artificial Sequence
  synthetic [barcode part1]
ccgtaggttcaacctc

SEQ ID NO: 32602 - DNA, 16 bp, Artificial Sequence
  synthetic [barcode part1]
tcgtaagtattccacc

SEQ ID NO: 32603 - DNA, 16 bp, Artificial Sequence
  synthetic [barcode part1]
cggtagtgtattcctt

SEQ ID NO: 32604 - DNA, 16 bp, Artificial Sequence
  synthetic [barcode part1]
tcaggattaggcaggc

SEQ ID NO: 32605 - DNA, 16 bp, Artificial Sequence
  synthetic [barcode part1]
ccgtaccgtctaacgt

SEQ ID NO: 32606 - DNA, 16 bp, Artificial Sequence
  synthetic [barcode part1]
ataaggacggtccgac

SEQ ID NO: 32607 - DNA, 16 bp, Artificial Sequence
  synthetic [barcode part1]
gtgaatcctctactac

SEQ ID NO: 32608 - DNA, 16 bp, Artificial Sequence
  synthetic [barcode part1]
tattccggcggatcct

SEQ ID NO: 32609 - DNA, 16 bp, Artificial Sequence
  synthetic [barcode part1]
ccagaccaacttagtg

SEQ ID NO: 32610 - DNA, 16 bp, Artificial Sequence
  synthetic [barcode part1]
tcgacgacttaacggt

SEQ ID NO: 32611 - DNA, 16 bp, Artificial Sequence
  synthetic [barcode part1]
ttcttaccaccggacg

SEQ ID NO: 32612 - DNA, 16 bp, Artificial Sequence
  synthetic [barcode part1]
ttcaggaatcacgacc

SEQ ID NO: 32613 - DNA, 16 bp, Artificial Sequence
  synthetic [barcode part1]
tacggtacttactcac

SEQ ID NO: 32614 - DNA, 16 bp, Artificial Sequence
  synthetic [barcode part1]
acacgacgattaaggt

SEQ ID NO: 32615 - DNA, 16 bp, Artificial Sequence
  synthetic [barcode part1]
caggaactatcctcag

SEQ ID NO: 32616 - DNA, 16 bp, Artificial Sequence
  synthetic [barcode part1]
gtcacgaccacctgtt

SEQ ID NO: 32617 - DNA, 16 bp, Artificial Sequence
  synthetic [barcode part1]
taatcgccgaatccag

SEQ ID NO: 32618 - DNA, 16 bp, Artificial Sequence
  synthetic [barcode part1]
gagttcagagtgtctc

SEQ ID NO: 32619 - DNA, 16 bp, Artificial Sequence
  synthetic [barcode part1]
ccagagattccgttag

SEQ ID NO: 32620 - DNA, 16 bp, Artificial Sequence
  synthetic [barcode part1]
agacgtgtggcagttg

SEQ ID NO: 32621 - DNA, 16 bp, Artificial Sequence
  synthetic [barcode part1]
attggcgcaagaagtt

SEQ ID NO: 32622 - DNA, 16 bp, Artificial Sequence
  synthetic [barcode part1]
ttgcacttcaccaagt

SEQ ID NO: 32623 - DNA, 16 bp, Artificial Sequence
  synthetic [barcode part1]
gtgagttgaaggtcgc

SEQ ID NO: 32624 - DNA, 16 bp, Artificial Sequence
  synthetic [barcode part1]
gattgcagtcacgtac

SEQ ID NO: 32625 - DNA, 16 bp, Artificial Sequence
  synthetic [barcode part1]
gtagtgtctcctcttc

SEQ ID NO: 32626 - DNA, 16 bp, Artificial Sequence
  synthetic [barcode part1]
gcggtactggtattac

SEQ ID NO: 32627 - DNA, 16 bp, Artificial Sequence
  synthetic [barcode part1]
ccgaagaggttacgtg

SEQ ID NO: 32628 - DNA, 16 bp, Artificial Sequence
  synthetic [barcode part1]
tatcgccacaaggtac

SEQ ID NO: 32629 - DNA, 16 bp, Artificial Sequence
  synthetic [barcode part1]
cgattccgttaatacc

SEQ ID NO: 32630 - DNA, 16 bp, Artificial Sequence
  synthetic [barcode part1]
tggtagttctctgtac

SEQ ID NO: 32631 - DNA, 16 bp, Artificial Sequence
  synthetic [barcode part1]
accttgaggaaggaag

SEQ ID NO: 32632 - DNA, 16 bp, Artificial Sequence
  synthetic [barcode part1]
accgtctgttctgttc

SEQ ID NO: 32633 - DNA, 16 bp, Artificial Sequence
  synthetic [barcode part1]
attggtaccgtgcagt

SEQ ID NO: 32634 - DNA, 16 bp, Artificial Sequence
  synthetic [barcode part1]
gaggagtcaccgatac

SEQ ID NO: 32635 - DNA, 16 bp, Artificial Sequence
  synthetic [barcode part1]
gaattattcgtgcctc

SEQ ID NO: 32636 - DNA, 16 bp, Artificial Sequence
  synthetic [barcode part1]
caactcctgtgtgacc

SEQ ID NO: 32637 - DNA, 16 bp, Artificial Sequence
  synthetic [barcode part1]
acgactgcgtacaact

SEQ ID NO: 32638 - DNA, 16 bp, Artificial Sequence
  synthetic [barcode part1]
gaataggtctaggact

SEQ ID NO: 32639 - DNA, 16 bp, Artificial Sequence
  synthetic [barcode part1]
cactcctaactgttag

SEQ ID NO: 32640 - DNA, 16 bp, Artificial Sequence
  synthetic [barcode part1]
cctaacctgaccacac

SEQ ID NO: 32641 - DNA, 16 bp, Artificial Sequence
  synthetic [barcode part1]
tataggaacgcctctg

SEQ ID NO: 32642 - DNA, 16 bp, Artificial Sequence
  synthetic [barcode part1]
gcactgcaatactgtg

SEQ ID NO: 32643 - DNA, 16 bp, Artificial Sequence
  synthetic [barcode part1]
tgttcacgaatctcgt

SEQ ID NO: 32644 - DNA, 16 bp, Artificial Sequence
  synthetic [barcode part1]
tgacaggtgtcacttg

SEQ ID NO: 32645 - DNA, 16 bp, Artificial Sequence
  synthetic [barcode part1]
agtgtcgaggagaagt

SEQ ID NO: 32646 - DNA, 16 bp, Artificial Sequence
  synthetic [barcode part1]
gttggaccggactatt

SEQ ID NO: 32647 - DNA, 16 bp, Artificial Sequence
  synthetic [barcode part1]
ccaacgaagacacggt

SEQ ID NO: 32648 - DNA, 16 bp, Artificial Sequence
  synthetic [barcode part1]
tcgcgtcaataatcct

SEQ ID NO: 32649 - DNA, 16 bp, Artificial Sequence
  synthetic [barcode part1]
agatctctggcgttag

SEQ ID NO: 32650 - DNA, 16 bp, Artificial Sequence
  synthetic [barcode part1]
gtgattgtgcggttac

SEQ ID NO: 32651 - DNA, 16 bp, Artificial Sequence
  synthetic [barcode part1]
tggtcggaacttcaac

SEQ ID NO: 32652 - DNA, 16 bp, Artificial Sequence
  synthetic [barcode part1]
tacgaggttaacggcg

SEQ ID NO: 32653 - DNA, 16 bp, Artificial Sequence
  synthetic [barcode part1]
attaggagaccaggag

SEQ ID NO: 32654 - DNA, 16 bp, Artificial Sequence
  synthetic [barcode part1]
tcagacaacgagttcc

SEQ ID NO: 32655 - DNA, 16 bp, Artificial Sequence
  synthetic [barcode part1]
gtgattctccgacaag

SEQ ID NO: 32656 - DNA, 16 bp, Artificial Sequence
  synthetic [barcode part1]
gttgacaattctctgc

SEQ ID NO: 32657 - DNA, 16 bp, Artificial Sequence
  synthetic [barcode part1]
tccacggtattcgaag

SEQ ID NO: 32658 - DNA, 16 bp, Artificial Sequence
  synthetic [barcode part1]
ttccttcaatcggtcc

SEQ ID NO: 32659 - DNA, 16 bp, Artificial Sequence
  synthetic [barcode part1]
tggtcaactcttcctc

SEQ ID NO: 32660 - DNA, 16 bp, Artificial Sequence
  synthetic [barcode part1]
tagacgcgtgcaatct

SEQ ID NO: 32661 - DNA, 16 bp, Artificial Sequence
  synthetic [barcode part1]
tcagtcaacgttgcag

SEQ ID NO: 32662 - DNA, 16 bp, Artificial Sequence
  synthetic [barcode part1]
atccggacaggacagt

SEQ ID NO: 32663 - DNA, 16 bp, Artificial Sequence
  synthetic [barcode part1]
gcggattgtgcaatct

SEQ ID NO: 32664 - DNA, 16 bp, Artificial Sequence
  synthetic [barcode part1]
tattccagtctcgtcc

SEQ ID NO: 32665 - DNA, 16 bp, Artificial Sequence
  synthetic [barcode part1]
tgcggaccaggataac

SEQ ID NO: 32666 - DNA, 16 bp, Artificial Sequence
  synthetic [barcode part1]
aggtatcaacgaagtc

SEQ ID NO: 32667 - DNA, 16 bp, Artificial Sequence
  synthetic [barcode part1]
taactctcacggccac

SEQ ID NO: 32668 - DNA, 16 bp, Artificial Sequence
  synthetic [barcode part1]
gcagattacgcagttc

SEQ ID NO: 32669 - DNA, 16 bp, Artificial Sequence
  synthetic [barcode part1]
aactccaaccttggag

SEQ ID NO: 32670 - DNA, 16 bp, Artificial Sequence
  synthetic [barcode part1]
cctctgattggaagac

SEQ ID NO: 32671 - DNA, 16 bp, Artificial Sequence
  synthetic [barcode part1]
agttcagtgtgttctc

SEQ ID NO: 32672 - DNA, 16 bp, Artificial Sequence
  synthetic [barcode part1]
attgagttccgcgcct

SEQ ID NO: 32673 - DNA, 16 bp, Artificial Sequence
  synthetic [barcode part1]
cctattatcgacgcgc

SEQ ID NO: 32674 - DNA, 16 bp, Artificial Sequence
  synthetic [barcode part1]
agaaggaagttgaccg

SEQ ID NO: 32675 - DNA, 16 bp, Artificial Sequence
  synthetic [barcode part1]
atacgtgcgactgatc

SEQ ID NO: 32676 - DNA, 16 bp, Artificial Sequence
  synthetic [barcode part1]
tggtacacgtggattc

SEQ ID NO: 32677 - DNA, 16 bp, Artificial Sequence
  synthetic [barcode part1]
ttgaaccgactcagtg

SEQ ID NO: 32678 - DNA, 16 bp, Artificial Sequence
  synthetic [barcode part1]
cgtgtcctatcaagtt

SEQ ID NO: 32679 - DNA, 16 bp, Artificial Sequence
  synthetic [barcode part1]
atcacgagtagacaac

SEQ ID NO: 32680 - DNA, 16 bp, Artificial Sequence
  synthetic [barcode part1]
gtagacgacctacttg

SEQ ID NO: 32681 - DNA, 16 bp, Artificial Sequence
  synthetic [barcode part1]
accaacacttgcgaac

SEQ ID NO: 32682 - DNA, 16 bp, Artificial Sequence
  synthetic [barcode part1]
ttggcagttgcgtcct

SEQ ID NO: 32683 - DNA, 16 bp, Artificial Sequence
  synthetic [barcode part1]
tgtacagttcagttcc

SEQ ID NO: 32684 - DNA, 16 bp, Artificial Sequence
  synthetic [barcode part1]
cgatagtcggtctaac

SEQ ID NO: 32685 - DNA, 16 bp, Artificial Sequence
  synthetic [barcode part1]
atctcacttcggcctt

SEQ ID NO: 32686 - DNA, 16 bp, Artificial Sequence
  synthetic [barcode part1]
ttgataaggtacaggc

SEQ ID NO: 32687 - DNA, 16 bp, Artificial Sequence
  synthetic [barcode part1]
cgtgaatcggagtgac

SEQ ID NO: 32688 - DNA, 16 bp, Artificial Sequence
  synthetic [barcode part1]
taatatcggcgaacag

SEQ ID NO: 32689 - DNA, 16 bp, Artificial Sequence
  synthetic [barcode part1]
gacaggttgccacaag

SEQ ID NO: 32690 - DNA, 16 bp, Artificial Sequence
  synthetic [barcode part1]
tggaacgaatacgttg

SEQ ID NO: 32691 - DNA, 16 bp, Artificial Sequence
  synthetic [barcode part1]
gtactcttaactcggt

SEQ ID NO: 32692 - DNA, 16 bp, Artificial Sequence
  synthetic [barcode part1]
actgacaacgactacc

SEQ ID NO: 32693 - DNA, 16 bp, Artificial Sequence
  synthetic [barcode part1]
tcggtctcggacttac

SEQ ID NO: 32694 - DNA, 16 bp, Artificial Sequence
  synthetic [barcode part1]
acagacttcgaacgtc

SEQ ID NO: 32695 - DNA, 16 bp, Artificial Sequence
  synthetic [barcode part1]
tacggttaccaagaag

SEQ ID NO: 32696 - DNA, 16 bp, Artificial Sequence
  synthetic [barcode part1]
taatcggccttaggac

SEQ ID NO: 32697 - DNA, 16 bp, Artificial Sequence
  synthetic [barcode part1]
tagatccgttctactg

SEQ ID NO: 32698 - DNA, 16 bp, Artificial Sequence
  synthetic [barcode part1]
gcaggcgttacagtag

SEQ ID NO: 32699 - DNA, 16 bp, Artificial Sequence
  synthetic [barcode part1]
ttaggacagtaagtgc

SEQ ID NO: 32700 - DNA, 16 bp, Artificial Sequence
  synthetic [barcode part1]
gtgagacgtaggttcg

SEQ ID NO: 32701 - DNA, 16 bp, Artificial Sequence
  synthetic [barcode part1]
cgtgatattcgcctgc

SEQ ID NO: 32702 - DNA, 16 bp, Artificial Sequence
  synthetic [barcode part1]
tacggagagtctggtg

SEQ ID NO: 32703 - DNA, 16 bp, Artificial Sequence
  synthetic [barcode part1]
tggttacacttctcag

SEQ ID NO: 32704 - DNA, 16 bp, Artificial Sequence
  synthetic [barcode part1]
cacaacagtctacttc

SEQ ID NO: 32705 - DNA, 16 bp, Artificial Sequence
  synthetic [barcode part1]
ccgtaggtatcctgtc

SEQ ID NO: 32706 - DNA, 16 bp, Artificial Sequence
  synthetic [barcode part1]
gtgaccgaacttctcc

SEQ ID NO: 32707 - DNA, 16 bp, Artificial Sequence
  synthetic [barcode part1]
gcaagacttacggacg

SEQ ID NO: 32708 - DNA, 16 bp, Artificial Sequence
  synthetic [barcode part1]
ccttccacaggtctag

SEQ ID NO: 32709 - DNA, 16 bp, Artificial Sequence
  synthetic [barcode part1]
cgcctactcgtctatt

SEQ ID NO: 32710 - DNA, 16 bp, Artificial Sequence
  synthetic [barcode part1]
cacgtagtccgtaagt

SEQ ID NO: 32711 - DNA, 16 bp, Artificial Sequence
  synthetic [barcode part1]
caagaggcagtatatc

SEQ ID NO: 32712 - DNA, 16 bp, Artificial Sequence
  synthetic [barcode part1]
ccagtatctggtcctg

SEQ ID NO: 32713 - DNA, 16 bp, Artificial Sequence
  synthetic [barcode part1]
acgtaggattctcgtg

SEQ ID NO: 32714 - DNA, 16 bp, Artificial Sequence
  synthetic [barcode part1]
ttctgttgcggatccg

SEQ ID NO: 32715 - DNA, 16 bp, Artificial Sequence
  synthetic [barcode part1]
tctctctaccgattgc

SEQ ID NO: 32716 - DNA, 16 bp, Artificial Sequence
  synthetic [barcode part1]
actgtggagtaccact

SEQ ID NO: 32717 - DNA, 16 bp, Artificial Sequence
  synthetic [barcode part1]
gagacttctgcctacc

SEQ ID NO: 32718 - DNA, 16 bp, Artificial Sequence
  synthetic [barcode part1]
tgagaggtggtacacc

SEQ ID NO: 32719 - DNA, 16 bp, Artificial Sequence
  synthetic [barcode part1]
atctgcctactgcgac

SEQ ID NO: 32720 - DNA, 16 bp, Artificial Sequence
  synthetic [barcode part1]
ttactggccagactag

SEQ ID NO: 32721 - DNA, 16 bp, Artificial Sequence
  synthetic [barcode part1]
gacttccttgagtatc

SEQ ID NO: 32722 - DNA, 16 bp, Artificial Sequence
  synthetic [barcode part1]
cacacgacgaatctgt

SEQ ID NO: 32723 - DNA, 16 bp, Artificial Sequence
  synthetic [barcode part1]
atctcaggtcaaccag

SEQ ID NO: 32724 - DNA, 16 bp, Artificial Sequence
  synthetic [barcode part1]
tctagtgtgccaagtg

SEQ ID NO: 32725 - DNA, 16 bp, Artificial Sequence
  synthetic [barcode part1]
gcacaaggaacgtaag

SEQ ID NO: 32726 - DNA, 16 bp, Artificial Sequence
  synthetic [barcode part1]
caactcctgcacaacc

SEQ ID NO: 32727 - DNA, 16 bp, Artificial Sequence
  synthetic [barcode part1]
gcaaggagattgtcgc

SEQ ID NO: 32728 - DNA, 16 bp, Artificial Sequence
  synthetic [barcode part1]
ttcctctccttaggac

SEQ ID NO: 32729 - DNA, 16 bp, Artificial Sequence
  synthetic [barcode part1]
attctctccagtcctg

SEQ ID NO: 32730 - DNA, 16 bp, Artificial Sequence
  synthetic [barcode part1]
aggttcgtcactactt

SEQ ID NO: 32731 - DNA, 16 bp, Artificial Sequence
  synthetic [barcode part1]
aactcggactatcggt

SEQ ID NO: 32732 - DNA, 16 bp, Artificial Sequence
  synthetic [barcode part1]
ttacgtgcacgatcag

SEQ ID NO: 32733 - DNA, 16 bp, Artificial Sequence
  synthetic [barcode part1]
taacgcagattcgtgc

SEQ ID NO: 32734 - DNA, 16 bp, Artificial Sequence
  synthetic [barcode part1]
gttagtatccagtcct

SEQ ID NO: 32735 - DNA, 16 bp, Artificial Sequence
  synthetic [barcode part1]
tatccgttactacggt

SEQ ID NO: 32736 - DNA, 16 bp, Artificial Sequence
  synthetic [barcode part1]
gagtagattgcagtgt

SEQ ID NO: 32737 - DNA, 16 bp, Artificial Sequence
  synthetic [barcode part1]
cgagaacaatacggag

SEQ ID NO: 32738 - DNA, 16 bp, Artificial Sequence
  synthetic [barcode part1]
acagttgactgcacac

SEQ ID NO: 32739 - DNA, 16 bp, Artificial Sequence
  synthetic [barcode part1]
tgcgagtgtgataagt

SEQ ID NO: 32740 - DNA, 16 bp, Artificial Sequence
  synthetic [barcode part1]
agttcgacagtgatcc

SEQ ID NO: 32741 - DNA, 16 bp, Artificial Sequence
  synthetic [barcode part1]
gcggactgtcaagaac

SEQ ID NO: 32742 - DNA, 16 bp, Artificial Sequence
  synthetic [barcode part1]
gacacacacaccaact

SEQ ID NO: 32743 - DNA, 16 bp, Artificial Sequence
  synthetic [barcode part1]
gcaagaactccacgtt

SEQ ID NO: 32744 - DNA, 16 bp, Artificial Sequence
  synthetic [barcode part1]
cctagtccaactatac

SEQ ID NO: 32745 - DNA, 16 bp, Artificial Sequence
  synthetic [barcode part1]
gatcggtcaatcgact

SEQ ID NO: 32746 - DNA, 16 bp, Artificial Sequence
  synthetic [barcode part1]
acaattgtctcgacct

SEQ ID NO: 32747 - DNA, 16 bp, Artificial Sequence
  synthetic [barcode part1]
ttcttgaattggcgtc

SEQ ID NO: 32748 - DNA, 16 bp, Artificial Sequence
  synthetic [barcode part1]
tggtagtcgtgccttc

SEQ ID NO: 32749 - DNA, 16 bp, Artificial Sequence
  synthetic [barcode part1]
atcggtggtctggatt

SEQ ID NO: 32750 - DNA, 16 bp, Artificial Sequence
  synthetic [barcode part1]
cgatctcgtataccgc

SEQ ID NO: 32751 - DNA, 16 bp, Artificial Sequence
  synthetic [barcode part1]
atctaggtatcacctc

SEQ ID NO: 32752 - DNA, 16 bp, Artificial Sequence
  synthetic [barcode part1]
cgaggtatatcttgcg

SEQ ID NO: 32753 - DNA, 16 bp, Artificial Sequence
  synthetic [barcode part1]
gcgttagactatctct

SEQ ID NO: 32754 - DNA, 16 bp, Artificial Sequence
  synthetic [barcode part1]
actgtgaagacggacc

SEQ ID NO: 32755 - DNA, 16 bp, Artificial Sequence
  synthetic [barcode part1]
cgcactggatcagaag

SEQ ID NO: 32756 - DNA, 16 bp, Artificial Sequence
  synthetic [barcode part1]
cctaacaagtacgaag

SEQ ID NO: 32757 - DNA, 16 bp, Artificial Sequence
  synthetic [barcode part1]
atctctacctgcactc

SEQ ID NO: 32758 - DNA, 16 bp, Artificial Sequence
  synthetic [barcode part1]
cgagttagtgccttcc

SEQ ID NO: 32759 - DNA, 16 bp, Artificial Sequence
  synthetic [barcode part1]
cagactgtgtgttctt

SEQ ID NO: 32760 - DNA, 16 bp, Artificial Sequence
  synthetic [barcode part1]
tcttacgagtctggtt

SEQ ID NO: 32761 - DNA, 16 bp, Artificial Sequence
  synthetic [barcode part1]
agtgaggcacactgac

SEQ ID NO: 32762 - DNA, 16 bp, Artificial Sequence
  synthetic [barcode part1]
gaataggtgttcgcct

SEQ ID NO: 32763 - DNA, 16 bp, Artificial Sequence
  synthetic [barcode part1]
tgtagacctcgagtac

SEQ ID NO: 32764 - DNA, 16 bp, Artificial Sequence
  synthetic [barcode part1]
tgcggtctccttaacg

SEQ ID NO: 32765 - DNA, 16 bp, Artificial Sequence
  synthetic [barcode part1]
tacgagttgagacaac

SEQ ID NO: 32766 - DNA, 16 bp, Artificial Sequence
  synthetic [barcode part1]
agaactactggacgcg

SEQ ID NO: 32767 - DNA, 16 bp, Artificial Sequence
  synthetic [barcode part1]
gtgaggtacaggttcg

SEQ ID NO: 32768 - DNA, 16 bp, Artificial Sequence
  synthetic [barcode part1]
gagttgtgagttgtcc

SEQ ID NO: 32769 - DNA, 16 bp, Artificial Sequence
  synthetic [barcode part1]
ttgaccacctctcttg

SEQ ID NO: 32770 - DNA, 16 bp, Artificial Sequence
  synthetic [barcode part1]
tacgactacgtaaccg

SEQ ID NO: 32771 - DNA, 16 bp, Artificial Sequence
  synthetic [barcode part1]
aggtctgcgagagact

SEQ ID NO: 32772 - DNA, 16 bp, Artificial Sequence
  synthetic [barcode part1]
atcttacaacggtggc

SEQ ID NO: 32773 - DNA, 16 bp, Artificial Sequence
  synthetic [barcode part1]
tctccttctctgagac

SEQ ID NO: 32774 - DNA, 16 bp, Artificial Sequence
  synthetic [barcode part1]
gtagttatcctccagt

SEQ ID NO: 32775 - DNA, 16 bp, Artificial Sequence
  synthetic [barcode part1]
accgattaggaaggag

SEQ ID NO: 32776 - DNA, 16 bp, Artificial Sequence
  synthetic [barcode part1]
acgtcctaccgttgac

SEQ ID NO: 32777 - DNA, 16 bp, Artificial Sequence
  synthetic [barcode part1]
aagatactcggatcag

SEQ ID NO: 32778 - DNA, 16 bp, Artificial Sequence
  synthetic [barcode part1]
caggtcctatcgttcg

SEQ ID NO: 32779 - DNA, 16 bp, Artificial Sequence
  synthetic [barcode part1]
gatctgttcaccttag

SEQ ID NO: 32780 - DNA, 16 bp, Artificial Sequence
  synthetic [barcode part1]
tcaatccactcgagtt

SEQ ID NO: 32781 - DNA, 16 bp, Artificial Sequence
  synthetic [barcode part1]
ttctctctcggaactc

SEQ ID NO: 32782 - DNA, 16 bp, Artificial Sequence
  synthetic [barcode part1]
tggcgacaaggtgtac

SEQ ID NO: 32783 - DNA, 16 bp, Artificial Sequence
  synthetic [barcode part1]
acctgtaatcaaggag

SEQ ID NO: 32784 - DNA, 16 bp, Artificial Sequence
  synthetic [barcode part1]
atcctccaaccagaag

SEQ ID NO: 32785 - DNA, 16 bp, Artificial Sequence
  synthetic [barcode part1]
gccttactctatagac

SEQ ID NO: 32786 - DNA, 16 bp, Artificial Sequence
  synthetic [barcode part1]
atcacgagacaggcac

SEQ ID NO: 32787 - DNA, 16 bp, Artificial Sequence
  synthetic [barcode part1]
acggtgactcgtgaag

SEQ ID NO: 32788 - DNA, 16 bp, Artificial Sequence
  synthetic [barcode part1]
ccgtactagtgactcc

SEQ ID NO: 32789 - DNA, 16 bp, Artificial Sequence
  synthetic [barcode part1]
tacacacgtgtgtacg

SEQ ID NO: 32790 - DNA, 16 bp, Artificial Sequence
  synthetic [barcode part1]
actccaagatcgactg

SEQ ID NO: 32791 - DNA, 16 bp, Artificial Sequence
  synthetic [barcode part1]
gacgtgcctaaggaac

SEQ ID NO: 32792 - DNA, 16 bp, Artificial Sequence
  synthetic [barcode part1]
aagaatcgccaatacg

SEQ ID NO: 32793 - DNA, 16 bp, Artificial Sequence
  synthetic [barcode part1]
tctatcgtgcaagtct

SEQ ID NO: 32794 - DNA, 16 bp, Artificial Sequence
  synthetic [barcode part1]
attctcgcgtcagatt

SEQ ID NO: 32795 - DNA, 16 bp, Artificial Sequence
  synthetic [barcode part1]
tcttgtgaaccgttgt

SEQ ID NO: 32796 - DNA, 16 bp, Artificial Sequence
  synthetic [barcode part1]
caagttgttggcgatc

SEQ ID NO: 32797 - DNA, 16 bp, Artificial Sequence
  synthetic [barcode part1]
gactctcgaagtaacc

SEQ ID NO: 32798 - DNA, 16 bp, Artificial Sequence
  synthetic [barcode part1]
gcggattagttcgtgt

SEQ ID NO: 32799 - DNA, 16 bp, Artificial Sequence
  synthetic [barcode part1]
gaccgatagaagaggt

SEQ ID NO: 32800 - DNA, 16 bp, Artificial Sequence
  synthetic [barcode part1]
acggttattagaaggc

SEQ ID NO: 32801 - DNA, 16 bp, Artificial Sequence
  synthetic [barcode part1]
taacacgtagtcttcc

SEQ ID NO: 32802 - DNA, 16 bp, Artificial Sequence
  synthetic [barcode part1]
acgtactgtgagatag

SEQ ID NO: 32803 - DNA, 16 bp, Artificial Sequence
  synthetic [barcode part1]
cgcacctcactagact

SEQ ID NO: 32804 - DNA, 16 bp, Artificial Sequence
  synthetic [barcode part1]
agtaaccgttggactc

SEQ ID NO: 32805 - DNA, 16 bp, Artificial Sequence
  synthetic [barcode part1]
ttgacttgcaatcacc

SEQ ID NO: 32806 - DNA, 16 bp, Artificial Sequence
  synthetic [barcode part1]
agttcctccgaatact

SEQ ID NO: 32807 - DNA, 16 bp, Artificial Sequence
  synthetic [barcode part1]
tcaagaagatccgtag

SEQ ID NO: 32808 - DNA, 16 bp, Artificial Sequence
  synthetic [barcode part1]
ccacgccgataacttc

SEQ ID NO: 32809 - DNA, 16 bp, Artificial Sequence
  synthetic [barcode part1]
caaccaaggccaattc

SEQ ID NO: 32810 - DNA, 16 bp, Artificial Sequence
  synthetic [barcode part1]
tacgtagaggtactcc

SEQ ID NO: 32811 - DNA, 16 bp, Artificial Sequence
  synthetic [barcode part1]
gttatagtccactcgt

SEQ ID NO: 32812 - DNA, 16 bp, Artificial Sequence
  synthetic [barcode part1]
gcagagtcgaataccg

SEQ ID NO: 32813 - DNA, 16 bp, Artificial Sequence
  synthetic [barcode part1]
gtcgtctgtcttatcc

SEQ ID NO: 32814 - DNA, 16 bp, Artificial Sequence
  synthetic [barcode part1]
aactggccttctcctt

SEQ ID NO: 32815 - DNA, 16 bp, Artificial Sequence
  synthetic [barcode part1]
acgccgagttatctcc

SEQ ID NO: 32816 - DNA, 16 bp, Artificial Sequence
  synthetic [barcode part1]
cgtataacaccggtgt

SEQ ID NO: 32817 - DNA, 16 bp, Artificial Sequence
  synthetic [barcode part1]
acgtggttgactacgt

SEQ ID NO: 32818 - DNA, 16 bp, Artificial Sequence
  synthetic [barcode part1]
taggccgttaacgatc

SEQ ID NO: 32819 - DNA, 16 bp, Artificial Sequence
  synthetic [barcode part1]
ccgattcgtaggatac

SEQ ID NO: 32820 - DNA, 16 bp, Artificial Sequence
  synthetic [barcode part1]
cgcaagtgataagact

SEQ ID NO: 32821 - DNA, 16 bp, Artificial Sequence
  synthetic [barcode part1]
cggtaagaacagagtg

SEQ ID NO: 32822 - DNA, 16 bp, Artificial Sequence
  synthetic [barcode part1]
tcagacagaacctacc

SEQ ID NO: 32823 - DNA, 16 bp, Artificial Sequence
  synthetic [barcode part1]
cggtcgtagatattcg

SEQ ID NO: 32824 - DNA, 16 bp, Artificial Sequence
  synthetic [barcode part1]
actcgttacctgtcct

SEQ ID NO: 32825 - DNA, 16 bp, Artificial Sequence
  synthetic [barcode part1]
attgtatcgacgagag

SEQ ID NO: 32826 - DNA, 16 bp, Artificial Sequence
  synthetic [barcode part1]
tcgaatcttcctgtag

SEQ ID NO: 32827 - DNA, 16 bp, Artificial Sequence
  synthetic [barcode part1]
tgacgacaatccggtt

SEQ ID NO: 32828 - DNA, 16 bp, Artificial Sequence
  synthetic [barcode part1]
acgaacgttactcgtg

SEQ ID NO: 32829 - DNA, 16 bp, Artificial Sequence
  synthetic [barcode part1]
cgttaccgaatacttc

SEQ ID NO: 32830 - DNA, 16 bp, Artificial Sequence
  synthetic [barcode part1]
cgtgtcgcaatatacg

SEQ ID NO: 32831 - DNA, 16 bp, Artificial Sequence
  synthetic [barcode part1]
aggcaagacgagtaac

SEQ ID NO: 32832 - DNA, 16 bp, Artificial Sequence
  synthetic [barcode part1]
acgccacctattcacg

SEQ ID NO: 32833 - DNA, 16 bp, Artificial Sequence
  synthetic [barcode part1]
acctatcacgagtggt

SEQ ID NO: 32834 - DNA, 16 bp, Artificial Sequence
  synthetic [barcode part1]
attcgcaagagtggcg

SEQ ID NO: 32835 - DNA, 16 bp, Artificial Sequence
  synthetic [barcode part1]
cgataggtccgagtag

SEQ ID NO: 32836 - DNA, 16 bp, Artificial Sequence
  synthetic [barcode part1]
gatctcagacgttgtg

SEQ ID NO: 32837 - DNA, 16 bp, Artificial Sequence
  synthetic [barcode part1]
tgatcctcgtgcggtt

SEQ ID NO: 32838 - DNA, 16 bp, Artificial Sequence
  synthetic [barcode part1]
cacgaacgtgaactct

SEQ ID NO: 32839 - DNA, 16 bp, Artificial Sequence
  synthetic [barcode part1]
gagatattgacctgag

SEQ ID NO: 32840 - DNA, 16 bp, Artificial Sequence
  synthetic [barcode part1]
ttgtccgtaggactcc

SEQ ID NO: 32841 - DNA, 16 bp, Artificial Sequence
  synthetic [barcode part1]
tcactgatacgaagag

SEQ ID NO: 32842 - DNA, 16 bp, Artificial Sequence
  synthetic [barcode part1]
tatactccgcctctac

SEQ ID NO: 32843 - DNA, 16 bp, Artificial Sequence
  synthetic [barcode part1]
gactgatattgtggcc

SEQ ID NO: 32844 - DNA, 16 bp, Artificial Sequence
  synthetic [barcode part1]
tcggtggtagactatc

SEQ ID NO: 32845 - DNA, 16 bp, Artificial Sequence
  synthetic [barcode part1]
aacagtccagtggttc

SEQ ID NO: 32846 - DNA, 16 bp, Artificial Sequence
  synthetic [barcode part1]
ttctaacgtcgaaggc

SEQ ID NO: 32847 - DNA, 16 bp, Artificial Sequence
  synthetic [barcode part1]
gcgaccaccaattctc

SEQ ID NO: 32848 - DNA, 16 bp, Artificial Sequence
  synthetic [barcode part1]
gacgtgtgtactgact

SEQ ID NO: 32849 - DNA, 16 bp, Artificial Sequence
  synthetic [barcode part1]
gattcgtgacgaggtg

SEQ ID NO: 32850 - DNA, 16 bp, Artificial Sequence
  synthetic [barcode part1]
gccaacgtaggagatc

SEQ ID NO: 32851 - DNA, 16 bp, Artificial Sequence
  synthetic [barcode part1]
cactccggtgaatcct

SEQ ID NO: 32852 - DNA, 16 bp, Artificial Sequence
  synthetic [barcode part1]
agaagaggaagaggag

SEQ ID NO: 32853 - DNA, 16 bp, Artificial Sequence
  synthetic [barcode part1]
agtctacgtggacttg

SEQ ID NO: 32854 - DNA, 16 bp, Artificial Sequence
  synthetic [barcode part1]
gttcctgcaccgaatc

SEQ ID NO: 32855 - DNA, 16 bp, Artificial Sequence
  synthetic [barcode part1]
agacctgatctggact

SEQ ID NO: 32856 - DNA, 16 bp, Artificial Sequence
  synthetic [barcode part1]
tcgtctgcgttgtgac

SEQ ID NO: 32857 - DNA, 16 bp, Artificial Sequence
  synthetic [barcode part1]
gttcgaggttccgtct

SEQ ID NO: 32858 - DNA, 16 bp, Artificial Sequence
  synthetic [barcode part1]
cgtgtaagttcctcgc

SEQ ID NO: 32859 - DNA, 16 bp, Artificial Sequence
  synthetic [barcode part1]
cactctgaagtagtgc

SEQ ID NO: 32860 - DNA, 16 bp, Artificial Sequence
  synthetic [barcode part1]
gcgtagtgagattagt

SEQ ID NO: 32861 - DNA, 16 bp, Artificial Sequence
  synthetic [barcode part1]
gagatatcgcgttctg

SEQ ID NO: 32862 - DNA, 16 bp, Artificial Sequence
  synthetic [barcode part1]
tactccagtggcaagt

SEQ ID NO: 32863 - DNA, 16 bp, Artificial Sequence
  synthetic [barcode part1]
tggactaaccgttgac

SEQ ID NO: 32864 - DNA, 16 bp, Artificial Sequence
  synthetic [barcode part1]
gacagtcttctcgcgt

SEQ ID NO: 32865 - DNA, 16 bp, Artificial Sequence
  synthetic [barcode part1]
aggcactgataagact

SEQ ID NO: 32866 - DNA, 16 bp, Artificial Sequence
  synthetic [barcode part1]
ttccaacacacctagt

SEQ ID NO: 32867 - DNA, 16 bp, Artificial Sequence
  synthetic [barcode part1]
ttacaccttaccgagt

SEQ ID NO: 32868 - DNA, 16 bp, Artificial Sequence
  synthetic [barcode part1]
tgcctacctgtctatc

SEQ ID NO: 32869 - DNA, 16 bp, Artificial Sequence
  synthetic [barcode part1]
cctatccgcgatactg

SEQ ID NO: 32870 - DNA, 16 bp, Artificial Sequence
  synthetic [barcode part1]
gaagaccttgatctcg

SEQ ID NO: 32871 - DNA, 16 bp, Artificial Sequence
  synthetic [barcode part1]
gacttgtgagttcgtg

SEQ ID NO: 32872 - DNA, 16 bp, Artificial Sequence
  synthetic [barcode part1]
tagtctgtaagtcgcg

SEQ ID NO: 32873 - DNA, 16 bp, Artificial Sequence
  synthetic [barcode part1]
accaacgttactacct

SEQ ID NO: 32874 - DNA, 16 bp, Artificial Sequence
  synthetic [barcode part1]
gttggtacttacaggc

SEQ ID NO: 32875 - DNA, 16 bp, Artificial Sequence
  synthetic [barcode part1]
agattgcgcgaagacc

SEQ ID NO: 32876 - DNA, 16 bp, Artificial Sequence
  synthetic [barcode part1]
gattgcgcacgtgatt

SEQ ID NO: 32877 - DNA, 16 bp, Artificial Sequence
  synthetic [barcode part1]
gatctccaaccacacc

SEQ ID NO: 32878 - DNA, 16 bp, Artificial Sequence
  synthetic [barcode part1]
acgtgatacgccaatc

SEQ ID NO: 32879 - DNA, 16 bp, Artificial Sequence
  synthetic [barcode part1]
ttcctcttcaactggc

SEQ ID NO: 32880 - DNA, 16 bp, Artificial Sequence
  synthetic [barcode part1]
ccgaacgttactctgc

SEQ ID NO: 32881 - DNA, 16 bp, Artificial Sequence
  synthetic [barcode part1]
gcgccttcaatctggt

SEQ ID NO: 32882 - DNA, 16 bp, Artificial Sequence
  synthetic [barcode part1]
tccgtacacacttctc

SEQ ID NO: 32883 - DNA, 16 bp, Artificial Sequence
  synthetic [barcode part1]
agattgactctggtcg

SEQ ID NO: 32884 - DNA, 16 bp, Artificial Sequence
  synthetic [barcode part1]
acgtagtcggtgtatc

SEQ ID NO: 32885 - DNA, 16 bp, Artificial Sequence
  synthetic [barcode part1]
taatagttctctgcgc

SEQ ID NO: 32886 - DNA, 16 bp, Artificial Sequence
  synthetic [barcode part1]
tctccgataacgcgtc

SEQ ID NO: 32887 - DNA, 16 bp, Artificial Sequence
  synthetic [barcode part1]
ttaggcgagactcact

SEQ ID NO: 32888 - DNA, 16 bp, Artificial Sequence
  synthetic [barcode part1]
atcgcaacgtcgtaac

SEQ ID NO: 32889 - DNA, 16 bp, Artificial Sequence
  synthetic [barcode part1]
ttctcctgtatcgcac

SEQ ID NO: 32890 - DNA, 16 bp, Artificial Sequence
  synthetic [barcode part1]
accacgaggtaggtgt

SEQ ID NO: 32891 - DNA, 16 bp, Artificial Sequence
  synthetic [barcode part1]
caagtcagaggatatc

SEQ ID NO: 32892 - DNA, 16 bp, Artificial Sequence
  synthetic [barcode part1]
acaccggcctctaatc

SEQ ID NO: 32893 - DNA, 16 bp, Artificial Sequence
  synthetic [barcode part1]
atcgagtacgaggacc

SEQ ID NO: 32894 - DNA, 16 bp, Artificial Sequence
  synthetic [barcode part1]
ccttccagtaactgcg

SEQ ID NO: 32895 - DNA, 16 bp, Artificial Sequence
  synthetic [barcode part1]
tcagaggcacactgag

SEQ ID NO: 32896 - DNA, 16 bp, Artificial Sequence
  synthetic [barcode part1]
acttacgttggacacg

SEQ ID NO: 32897 - DNA, 16 bp, Artificial Sequence
  synthetic [barcode part1]
tgttgtcgtctctcgt

SEQ ID NO: 32898 - DNA, 16 bp, Artificial Sequence
  synthetic [barcode part1]
caggatcacacgtgtt

SEQ ID NO: 32899 - DNA, 16 bp, Artificial Sequence
  synthetic [barcode part1]
ccaagacaggttctgt

SEQ ID NO: 32900 - DNA, 16 bp, Artificial Sequence
  synthetic [barcode part1]
cgtactatcctggtcg

SEQ ID NO: 32901 - DNA, 16 bp, Artificial Sequence
  synthetic [barcode part1]
gccttctcagtacgtg

SEQ ID NO: 32902 - DNA, 16 bp, Artificial Sequence
  synthetic [barcode part1]
tatcactacggagtgc

SEQ ID NO: 32903 - DNA, 16 bp, Artificial Sequence
  synthetic [barcode part1]
atcgtactgacctccg

SEQ ID NO: 32904 - DNA, 16 bp, Artificial Sequence
  synthetic [barcode part1]
ccaacgcaatctcctg

SEQ ID NO: 32905 - DNA, 16 bp, Artificial Sequence
  synthetic [barcode part1]
aattcctcgcaggtcc

SEQ ID NO: 32906 - DNA, 16 bp, Artificial Sequence
  synthetic [barcode part1]
taccagacaccgaatc

SEQ ID NO: 32907 - DNA, 16 bp, Artificial Sequence
  synthetic [barcode part1]
tgcgtcctactagatt

SEQ ID NO: 32908 - DNA, 16 bp, Artificial Sequence
  synthetic [barcode part1]
gaatcctctcttcctg

SEQ ID NO: 32909 - DNA, 16 bp, Artificial Sequence
  synthetic [barcode part1]
tacaacgtcgcctacc

SEQ ID NO: 32910 - DNA, 16 bp, Artificial Sequence
  synthetic [barcode part1]
aagacaagtctgtgac

SEQ ID NO: 32911 - DNA, 16 bp, Artificial Sequence
  synthetic [barcode part1]
aggcagtatatccaag

SEQ ID NO: 32912 - DNA, 16 bp, Artificial Sequence
  synthetic [barcode part1]
agtgaccaccgttagt

SEQ ID NO: 32913 - DNA, 16 bp, Artificial Sequence
  synthetic [barcode part1]
aacgaggcgtaagtcc

SEQ ID NO: 32914 - DNA, 16 bp, Artificial Sequence
  synthetic [barcode part1]
acctaggttaccttgt

SEQ ID NO: 32915 - DNA, 16 bp, Artificial Sequence
  synthetic [barcode part1]
ttggtcctaggtccac

SEQ ID NO: 32916 - DNA, 16 bp, Artificial Sequence
  synthetic [barcode part1]
gattcagatcgagtcc

SEQ ID NO: 32917 - DNA, 16 bp, Artificial Sequence
  synthetic [barcode part1]
gatctgtcactcgaag

SEQ ID NO: 32918 - DNA, 16 bp, Artificial Sequence
  synthetic [barcode part1]
gtgatcaaggactaac

SEQ ID NO: 32919 - DNA, 16 bp, Artificial Sequence
  synthetic [barcode part1]
tggtcgacgcgatatt

SEQ ID NO: 32920 - DNA, 16 bp, Artificial Sequence
  synthetic [barcode part1]
taggttgtgtggaggc

SEQ ID NO: 32921 - DNA, 16 bp, Artificial Sequence
  synthetic [barcode part1]
ttggtgtgttggtacg

SEQ ID NO: 32922 - DNA, 16 bp, Artificial Sequence
  synthetic [barcode part1]
gaccgcgtcttctagt

SEQ ID NO: 32923 - DNA, 16 bp, Artificial Sequence
  synthetic [barcode part1]
attgacctcaaggtcg

SEQ ID NO: 32924 - DNA, 16 bp, Artificial Sequence
  synthetic [barcode part1]
aggcagatccggaatc

SEQ ID NO: 32925 - DNA, 16 bp, Artificial Sequence
  synthetic [barcode part1]
aacgtcagatcctgac

SEQ ID NO: 32926 - DNA, 16 bp, Artificial Sequence
  synthetic [barcode part1]
gtacaacaacctcttc

SEQ ID NO: 32927 - DNA, 16 bp, Artificial Sequence
  synthetic [barcode part1]
tactacttcgcacggc

SEQ ID NO: 32928 - DNA, 16 bp, Artificial Sequence
  synthetic [barcode part1]
atagtaccgcggtact

SEQ ID NO: 32929 - DNA, 16 bp, Artificial Sequence
  synthetic [barcode part1]
cacagtaatccacttc

SEQ ID NO: 32930 - DNA, 16 bp, Artificial Sequence
  synthetic [barcode part1]
ttaacctacggttgtc

SEQ ID NO: 32931 - DNA, 16 bp, Artificial Sequence
  synthetic [barcode part1]
tcaggagttggacgtg

SEQ ID NO: 32932 - DNA, 16 bp, Artificial Sequence
  synthetic [barcode part1]
taaccgtctgcacaag

SEQ ID NO: 32933 - DNA, 16 bp, Artificial Sequence
  synthetic [barcode part1]
tatcgtctactggtgt

SEQ ID NO: 32934 - DNA, 16 bp, Artificial Sequence
  synthetic [barcode part1]
gcacctccgatagtct

SEQ ID NO: 32935 - DNA, 16 bp, Artificial Sequence
  synthetic [barcode part1]
accgcactgtagattg

SEQ ID NO: 32936 - DNA, 16 bp, Artificial Sequence
  synthetic [barcode part1]
ttcagactggaggacg

SEQ ID NO: 32937 - DNA, 16 bp, Artificial Sequence
  synthetic [barcode part1]
actgacagtgactgtc

SEQ ID NO: 32938 - DNA, 16 bp, Artificial Sequence
  synthetic [barcode part1]
tgtggaccttgttgtt

SEQ ID NO: 32939 - DNA, 16 bp, Artificial Sequence
  synthetic [barcode part1]
aggattacctctggtg

SEQ ID NO: 32940 - DNA, 16 bp, Artificial Sequence
  synthetic [barcode part1]
taacctcaagaggcct

SEQ ID NO: 32941 - DNA, 16 bp, Artificial Sequence
  synthetic [barcode part1]
tcgtgttcagatcact

SEQ ID NO: 32942 - DNA, 16 bp, Artificial Sequence
  synthetic [barcode part1]
tgaaggcacctggtag

SEQ ID NO: 32943 - DNA, 16 bp, Artificial Sequence
  synthetic [barcode part1]
acgcgtgattgactac

SEQ ID NO: 32944 - DNA, 16 bp, Artificial Sequence
  synthetic [barcode part1]
gtattcggtggcagag

SEQ ID NO: 32945 - DNA, 16 bp, Artificial Sequence
  synthetic [barcode part1]
cgtcggaagatacgac

SEQ ID NO: 32946 - DNA, 16 bp, Artificial Sequence
  synthetic [barcode part1]
tatactaggtcaggag

SEQ ID NO: 32947 - DNA, 16 bp, Artificial Sequence
  synthetic [barcode part1]
ttgtatccagactgtc

SEQ ID NO: 32948 - DNA, 16 bp, Artificial Sequence
  synthetic [barcode part1]
gagtggactattcgtc

SEQ ID NO: 32949 - DNA, 16 bp, Artificial Sequence
  synthetic [barcode part1]
tatcgacgaagagttg

SEQ ID NO: 32950 - DNA, 16 bp, Artificial Sequence
  synthetic [barcode part1]
atataggcgaactacg

SEQ ID NO: 32951 - DNA, 16 bp, Artificial Sequence
  synthetic [barcode part1]
agacaataggacgacg

SEQ ID NO: 32952 - DNA, 16 bp, Artificial Sequence
  synthetic [barcode part1]
tgtccaatcttcaacg

SEQ ID NO: 32953 - DNA, 16 bp, Artificial Sequence
  synthetic [barcode part1]
ccggacgcctactatt

SEQ ID NO: 32954 - DNA, 16 bp, Artificial Sequence
  synthetic [barcode part1]
acaacgtactgcaacc

SEQ ID NO: 32955 - DNA, 16 bp, Artificial Sequence
  synthetic [barcode part1]
cgcaccaagaagactg

SEQ ID NO: 32956 - DNA, 16 bp, Artificial Sequence
  synthetic [barcode part1]
cactagtctctccgag

SEQ ID NO: 32957 - DNA, 16 bp, Artificial Sequence
  synthetic [barcode part1]
cgtgagtaacggaatt

SEQ ID NO: 32958 - DNA, 16 bp, Artificial Sequence
  synthetic [barcode part1]
cgaaggacgactgtac

SEQ ID NO: 32959 - DNA, 16 bp, Artificial Sequence
  synthetic [barcode part1]
caggcgtaaggatcac

SEQ ID NO: 32960 - DNA, 16 bp, Artificial Sequence
  synthetic [barcode part1]
cgagaagaactctctc

SEQ ID NO: 32961 - DNA, 16 bp, Artificial Sequence
  synthetic [barcode part1]
ccttaacctggcacgt

SEQ ID NO: 32962 - DNA, 16 bp, Artificial Sequence
  synthetic [barcode part1]
actgtaacggagtcct

SEQ ID NO: 32963 - DNA, 16 bp, Artificial Sequence
  synthetic [barcode part1]
agactcgtgcctcgtt

SEQ ID NO: 32964 - DNA, 16 bp, Artificial Sequence
  synthetic [barcode part1]
tcttcaaccgagagac

SEQ ID NO: 32965 - DNA, 16 bp, Artificial Sequence
  synthetic [barcode part1]
aaccacaagtcaagac

SEQ ID NO: 32966 - DNA, 16 bp, Artificial Sequence
  synthetic [barcode part1]
tgacaataggacgtgt

SEQ ID NO: 32967 - DNA, 16 bp, Artificial Sequence
  synthetic [barcode part1]
gtcgaaggtcgtgtag

SEQ ID NO: 32968 - DNA, 16 bp, Artificial Sequence
  synthetic [barcode part1]
gtgtctatccgaacag

SEQ ID NO: 32969 - DNA, 16 bp, Artificial Sequence
  synthetic [barcode part1]
gacaccgttgagattc

SEQ ID NO: 32970 - DNA, 16 bp, Artificial Sequence
  synthetic [barcode part1]
atctgcctctagaatc

SEQ ID NO: 32971 - DNA, 16 bp, Artificial Sequence
  synthetic [barcode part1]
cgcagtacgcctatct

SEQ ID NO: 32972 - DNA, 16 bp, Artificial Sequence
  synthetic [barcode part1]
gcacaagataatccag

SEQ ID NO: 32973 - DNA, 16 bp, Artificial Sequence
  synthetic [barcode part1]
taggacttggttgacc

SEQ ID NO: 32974 - DNA, 16 bp, Artificial Sequence
  synthetic [barcode part1]
cggagtaagattggag

SEQ ID NO: 32975 - DNA, 16 bp, Artificial Sequence
  synthetic [barcode part1]
gcgccttcgacttagt

SEQ ID NO: 32976 - DNA, 16 bp, Artificial Sequence
  synthetic [barcode part1]
gcggttattgactctt

SEQ ID NO: 32977 - DNA, 16 bp, Artificial Sequence
  synthetic [barcode part1]
atcctgtgcgaagtgt

SEQ ID NO: 32978 - DNA, 16 bp, Artificial Sequence
  synthetic [barcode part1]
cgagtgtacgtgatct

SEQ ID NO: 32979 - DNA, 16 bp, Artificial Sequence
  synthetic [barcode part1]
tcaagacacgagtggc

SEQ ID NO: 32980 - DNA, 16 bp, Artificial Sequence
  synthetic [barcode part1]
aatcgaccgaccaatc

SEQ ID NO: 32981 - DNA, 16 bp, Artificial Sequence
  synthetic [barcode part1]
cggagagaactgaagt

SEQ ID NO: 32982 - DNA, 16 bp, Artificial Sequence
  synthetic [barcode part1]
gccaggtgtgaagatc

SEQ ID NO: 32983 - DNA, 16 bp, Artificial Sequence
  synthetic [barcode part1]
atccaaggtaggttcc

SEQ ID NO: 32984 - DNA, 16 bp, Artificial Sequence
  synthetic [barcode part1]
accacttgcctacggt

SEQ ID NO: 32985 - DNA, 16 bp, Artificial Sequence
  synthetic [barcode part1]
ccttacctcacaggtg

SEQ ID NO: 32986 - DNA, 16 bp, Artificial Sequence
  synthetic [barcode part1]
tcctaatacacctgac

SEQ ID NO: 32987 - DNA, 16 bp, Artificial Sequence
  synthetic [barcode part1]
aagtagtaccgttccg

SEQ ID NO: 32988 - DNA, 16 bp, Artificial Sequence
  synthetic [barcode part1]
tgatagagaatccacg

SEQ ID NO: 32989 - DNA, 16 bp, Artificial Sequence
  synthetic [barcode part1]
tgtacttctcggcgac

SEQ ID NO: 32990 - DNA, 16 bp, Artificial Sequence
  synthetic [barcode part1]
agtcgcagagatcggt

SEQ ID NO: 32991 - DNA, 16 bp, Artificial Sequence
  synthetic [barcode part1]
gtcgtataatcgcacg

SEQ ID NO: 32992 - DNA, 16 bp, Artificial Sequence
  synthetic [barcode part1]
gactgacgttgcaact

SEQ ID NO: 32993 - DNA, 16 bp, Artificial Sequence
  synthetic [barcode part1]
atctggagtgagtctc

SEQ ID NO: 32994 - DNA, 16 bp, Artificial Sequence
  synthetic [barcode part1]
actatcttgcctagac

SEQ ID NO: 32995 - DNA, 16 bp, Artificial Sequence
  synthetic [barcode part1]
gtgactacttcctaac

SEQ ID NO: 32996 - DNA, 16 bp, Artificial Sequence
  synthetic [barcode part1]
tgtcagaacagaggcc

SEQ ID NO: 32997 - DNA, 16 bp, Artificial Sequence
  synthetic [barcode part1]
cagatactagtggaac

SEQ ID NO: 32998 - DNA, 16 bp, Artificial Sequence
  synthetic [barcode part1]
tcttcggtcaaggaac

SEQ ID NO: 32999 - DNA, 16 bp, Artificial Sequence
  synthetic [barcode part1]
tcaatccgatacacct

SEQ ID NO: 33000 - DNA, 16 bp, Artificial Sequence
  synthetic [barcode part1]
cacagtggcaatacct

SEQ ID NO: 33001 - DNA, 16 bp, Artificial Sequence
  synthetic [barcode part1]
gtagtctcttgcgtcg

SEQ ID NO: 33002 - DNA, 16 bp, Artificial Sequence
  synthetic [barcode part1]
cagaagacggcgtgtt

SEQ ID NO: 33003 - DNA, 16 bp, Artificial Sequence
  synthetic [barcode part1]
tgcaccttgtcgaacc

SEQ ID NO: 33004 - DNA, 16 bp, Artificial Sequence
  synthetic [barcode part1]
tctgaactgcctcacg

SEQ ID NO: 33005 - DNA, 16 bp, Artificial Sequence
  synthetic [barcode part1]
tctgaccgccaatacc

SEQ ID NO: 33006 - DNA, 16 bp, Artificial Sequence
  synthetic [barcode part1]
caagaggcacacgatc

SEQ ID NO: 33007 - DNA, 16 bp, Artificial Sequence
  synthetic [barcode part1]
gttgatcactgtgacg

SEQ ID NO: 33008 - DNA, 16 bp, Artificial Sequence
  synthetic [barcode part1]
caactagttggtcgac

SEQ ID NO: 33009 - DNA, 16 bp, Artificial Sequence
  synthetic [barcode part1]
tgtagacgagttcgtc

SEQ ID NO: 33010 - DNA, 16 bp, Artificial Sequence
  synthetic [barcode part1]
tcggttcgaatcagac

SEQ ID NO: 33011 - DNA, 16 bp, Artificial Sequence
  synthetic [barcode part1]
ccgaagacacaggttg

SEQ ID NO: 33012 - DNA, 16 bp, Artificial Sequence
  synthetic [barcode part1]
caattagaccgaccgt

SEQ ID NO: 33013 - DNA, 16 bp, Artificial Sequence
  synthetic [barcode part1]
tcaccactctaagtac

SEQ ID NO: 33014 - DNA, 16 bp, Artificial Sequence
  synthetic [barcode part1]
ataccttcggtgattc

SEQ ID NO: 33015 - DNA, 16 bp, Artificial Sequence
  synthetic [barcode part1]
actgtcactagtggtg

SEQ ID NO: 33016 - DNA, 16 bp, Artificial Sequence
  synthetic [barcode part1]
cagtgttctgcaacag

SEQ ID NO: 33017 - DNA, 16 bp, Artificial Sequence
  synthetic [barcode part1]
aatcggtaatcggtcc

SEQ ID NO: 33018 - DNA, 16 bp, Artificial Sequence
  synthetic [barcode part1]
gagtatcacttcactc

SEQ ID NO: 33019 - DNA, 16 bp, Artificial Sequence
  synthetic [barcode part1]
taccgatcgtaaccag

SEQ ID NO: 33020 - DNA, 16 bp, Artificial Sequence
  synthetic [barcode part1]
ataggtcgttaaggac

SEQ ID NO: 33021 - DNA, 16 bp, Artificial Sequence
  synthetic [barcode part1]
atctccggcaatctgc

SEQ ID NO: 33022 - DNA, 16 bp, Artificial Sequence
  synthetic [barcode part1]
agtcgagtagatctag

SEQ ID NO: 33023 - DNA, 16 bp, Artificial Sequence
  synthetic [barcode part1]
actcacactgaacacg

SEQ ID NO: 33024 - DNA, 16 bp, Artificial Sequence
  synthetic [barcode part1]
caggagttactggacg

SEQ ID NO: 33025 - DNA, 16 bp, Artificial Sequence
  synthetic [barcode part1]
accaaggttagtcctg

SEQ ID NO: 33026 - DNA, 16 bp, Artificial Sequence
  synthetic [barcode part1]
gaagagtcacctcact

SEQ ID NO: 33027 - DNA, 16 bp, Artificial Sequence
  synthetic [barcode part1]
tgcactaaggatcaag

SEQ ID NO: 33028 - DNA, 16 bp, Artificial Sequence
  synthetic [barcode part1]
tattcacgcgagtgac

SEQ ID NO: 33029 - DNA, 16 bp, Artificial Sequence
  synthetic [barcode part1]
ccaagtggagttcgtt

SEQ ID NO: 33030 - DNA, 16 bp, Artificial Sequence
  synthetic [barcode part1]
tgtactgcctcggttg

SEQ ID NO: 33031 - DNA, 16 bp, Artificial Sequence
  synthetic [barcode part1]
cagtagtccaggttac

SEQ ID NO: 33032 - DNA, 16 bp, Artificial Sequence
  synthetic [barcode part1]
tcacaagttaccactc

SEQ ID NO: 33033 - DNA, 16 bp, Artificial Sequence
  synthetic [barcode part1]
tacgttgcagtcacag

SEQ ID NO: 33034 - DNA, 16 bp, Artificial Sequence
  synthetic [barcode part1]
aataggaacgcctggc

SEQ ID NO: 33035 - DNA, 16 bp, Artificial Sequence
  synthetic [barcode part1]
agtgcagttcgacgag

SEQ ID NO: 33036 - DNA, 16 bp, Artificial Sequence
  synthetic [barcode part1]
aagaactcggtgcacg

SEQ ID NO: 33037 - DNA, 16 bp, Artificial Sequence
  synthetic [barcode part1]
caagacgacaattacg

SEQ ID NO: 33038 - DNA, 16 bp, Artificial Sequence
  synthetic [barcode part1]
tccggttcagttatac

SEQ ID NO: 33039 - DNA, 16 bp, Artificial Sequence
  synthetic [barcode part1]
ttaacaacaggccacc

SEQ ID NO: 33040 - DNA, 16 bp, Artificial Sequence
  synthetic [barcode part1]
ttgttacagacctacc

SEQ ID NO: 33041 - DNA, 16 bp, Artificial Sequence
  synthetic [barcode part1]
acgaaccagtctacgt

SEQ ID NO: 33042 - DNA, 16 bp, Artificial Sequence
  synthetic [barcode part1]
tcgccgttggaatagt

SEQ ID NO: 33043 - DNA, 16 bp, Artificial Sequence
  synthetic [barcode part1]
gcaaccacaacacgtt

SEQ ID NO: 33044 - DNA, 16 bp, Artificial Sequence
  synthetic [barcode part1]
acagacctaactctct

SEQ ID NO: 33045 - DNA, 16 bp, Artificial Sequence
  synthetic [barcode part1]
tgactctgaccaaggt

SEQ ID NO: 33046 - DNA, 16 bp, Artificial Sequence
  synthetic [barcode part1]
tgcagattctgccgtc

SEQ ID NO: 33047 - DNA, 16 bp, Artificial Sequence
  synthetic [barcode part1]
caaggtcttccagagt

SEQ ID NO: 33048 - DNA, 16 bp, Artificial Sequence
  synthetic [barcode part1]
tgttcgtctgtagtgt

SEQ ID NO: 33049 - DNA, 16 bp, Artificial Sequence
  synthetic [barcode part1]
cgccgttgaattaggt

SEQ ID NO: 33050 - DNA, 16 bp, Artificial Sequence
  synthetic [barcode part1]
gtccaagtggagtggt

SEQ ID NO: 33051 - DNA, 16 bp, Artificial Sequence
  synthetic [barcode part1]
ccggtgacctgtattc

SEQ ID NO: 33052 - DNA, 16 bp, Artificial Sequence
  synthetic [barcode part1]
taggtcagatctgacc

SEQ ID NO: 33053 - DNA, 16 bp, Artificial Sequence
  synthetic [barcode part1]
ttatagtcgactggcg

SEQ ID NO: 33054 - DNA, 16 bp, Artificial Sequence
  synthetic [barcode part1]
gatagtctggtagtcc

SEQ ID NO: 33055 - DNA, 16 bp, Artificial Sequence
  synthetic [barcode part1]
ttgcacagtgttggtg

SEQ ID NO: 33056 - DNA, 16 bp, Artificial Sequence
  synthetic [barcode part1]
agtcggagtggttgtg

SEQ ID NO: 33057 - DNA, 16 bp, Artificial Sequence
  synthetic [barcode part1]
tagacctactctgttg

SEQ ID NO: 33058 - DNA, 16 bp, Artificial Sequence
  synthetic [barcode part1]
cgcgaggtatatcttg

SEQ ID NO: 33059 - DNA, 16 bp, Artificial Sequence
  synthetic [barcode part1]
cctaagaccaactgac

SEQ ID NO: 33060 - DNA, 16 bp, Artificial Sequence
  synthetic [barcode part1]
ccgatccagtacgtct

SEQ ID NO: 33061 - DNA, 16 bp, Artificial Sequence
  synthetic [barcode part1]
tcacagtctgaagtcg

SEQ ID NO: 33062 - DNA, 16 bp, Artificial Sequence
  synthetic [barcode part1]
acggcgtctaactaac

SEQ ID NO: 33063 - DNA, 16 bp, Artificial Sequence
  synthetic [barcode part1]
atcgccgtatactccg

SEQ ID NO: 33064 - DNA, 16 bp, Artificial Sequence
  synthetic [barcode part1]
gtggttaggtcctctc

SEQ ID NO: 33065 - DNA, 16 bp, Artificial Sequence
  synthetic [barcode part1]
acctacagaagactag

SEQ ID NO: 33066 - DNA, 16 bp, Artificial Sequence
  synthetic [barcode part1]
gagaacgacttggcac

SEQ ID NO: 33067 - DNA, 16 bp, Artificial Sequence
  synthetic [barcode part1]
ccgacggaacaatctt

SEQ ID NO: 33068 - DNA, 16 bp, Artificial Sequence
  synthetic [barcode part1]
agttgaccacagtgtc

SEQ ID NO: 33069 - DNA, 16 bp, Artificial Sequence
  synthetic [barcode part1]
aggcaagtgagacctc

SEQ ID NO: 33070 - DNA, 16 bp, Artificial Sequence
  synthetic [barcode part1]
caatagacggatatcg

SEQ ID NO: 33071 - DNA, 16 bp, Artificial Sequence
  synthetic [barcode part1]
cgtacgacaccttatt

SEQ ID NO: 33072 - DNA, 16 bp, Artificial Sequence
  synthetic [barcode part1]
aggatctgagtcctac

SEQ ID NO: 33073 - DNA, 16 bp, Artificial Sequence
  synthetic [barcode part1]
cgaacagattcacctg

SEQ ID NO: 33074 - DNA, 16 bp, Artificial Sequence
  synthetic [barcode part1]
attgacggcaggacac

SEQ ID NO: 33075 - DNA, 16 bp, Artificial Sequence
  synthetic [barcode part1]
gccttcaataaggacc

SEQ ID NO: 33076 - DNA, 16 bp, Artificial Sequence
  synthetic [barcode part1]
cgatagtgaaggtatc

SEQ ID NO: 33077 - DNA, 16 bp, Artificial Sequence
  synthetic [barcode part1]
taaggatacgaaggcg

SEQ ID NO: 33078 - DNA, 16 bp, Artificial Sequence
  synthetic [barcode part1]
agaacgcaactgttag

SEQ ID NO: 33079 - DNA, 16 bp, Artificial Sequence
  synthetic [barcode part1]
tacctcacttgagtgt

SEQ ID NO: 33080 - DNA, 16 bp, Artificial Sequence
  synthetic [barcode part1]
gatctctgcgtaatct

SEQ ID NO: 33081 - DNA, 16 bp, Artificial Sequence
  synthetic [barcode part1]
cgatatccaaggttcg

SEQ ID NO: 33082 - DNA, 16 bp, Artificial Sequence
  synthetic [barcode part1]
tcactccgcgcaattg

SEQ ID NO: 33083 - DNA, 16 bp, Artificial Sequence
  synthetic [barcode part1]
ttgacgtcaacacacg

SEQ ID NO: 33084 - DNA, 16 bp, Artificial Sequence
  synthetic [barcode part1]
tctgaacggtacactg

SEQ ID NO: 33085 - DNA, 16 bp, Artificial Sequence
  synthetic [barcode part1]
ccttcactccaacgag

SEQ ID NO: 33086 - DNA, 16 bp, Artificial Sequence
  synthetic [barcode part1]
agtcacgaccgatact

SEQ ID NO: 33087 - DNA, 16 bp, Artificial Sequence
  synthetic [barcode part1]
cagtcaagaccaactc

SEQ ID NO: 33088 - DNA, 16 bp, Artificial Sequence
  synthetic [barcode part1]
aatctcgcagagttcg

SEQ ID NO: 33089 - DNA, 16 bp, Artificial Sequence
  synthetic [barcode part1]
cgtataccttcgagag

SEQ ID NO: 33090 - DNA, 16 bp, Artificial Sequence
  synthetic [barcode part1]
ccaataatccggtggt

SEQ ID NO: 33091 - DNA, 16 bp, Artificial Sequence
  synthetic [barcode part1]
acgttgtcgaagtctg

SEQ ID NO: 33092 - DNA, 16 bp, Artificial Sequence
  synthetic [barcode part1]
gacacgcaatcctctc

SEQ ID NO: 33093 - DNA, 16 bp, Artificial Sequence
  synthetic [barcode part1]
cgtctgtctcagagtc

SEQ ID NO: 33094 - DNA, 16 bp, Artificial Sequence
  synthetic [barcode part1]
aacggacacctcagag

SEQ ID NO: 33095 - DNA, 16 bp, Artificial Sequence
  synthetic [barcode part1]
gtccacgtaacggaag

SEQ ID NO: 33096 - DNA, 16 bp, Artificial Sequence
  synthetic [barcode part1]
gcggtaatcgttatcg

SEQ ID NO: 33097 - DNA, 16 bp, Artificial Sequence
  synthetic [barcode part1]
cgtcacgattgactag

SEQ ID NO: 33098 - DNA, 16 bp, Artificial Sequence
  synthetic [barcode part1]
acactggagttgcact

SEQ ID NO: 33099 - DNA, 16 bp, Artificial Sequence
  synthetic [barcode part1]
tggcacgatcaggaac

SEQ ID NO: 33100 - DNA, 16 bp, Artificial Sequence
  synthetic [barcode part1]
ttgttcagtagtgtcc

SEQ ID NO: 33101 - DNA, 16 bp, Artificial Sequence
  synthetic [barcode part1]
gactgacttggaacct

SEQ ID NO: 33102 - DNA, 16 bp, Artificial Sequence
  synthetic [barcode part1]
tggcgactgtatctcc

SEQ ID NO: 33103 - DNA, 16 bp, Artificial Sequence
  synthetic [barcode part1]
tgcactacgtgatcag

SEQ ID NO: 33104 - DNA, 16 bp, Artificial Sequence
  synthetic [barcode part1]
gagactgagtcacacg

SEQ ID NO: 33105 - DNA, 16 bp, Artificial Sequence
  synthetic [barcode part1]
tcgaagtctcaggatc

SEQ ID NO: 33106 - DNA, 16 bp, Artificial Sequence
  synthetic [barcode part1]
atagagtacttgcgag

SEQ ID NO: 33107 - DNA, 16 bp, Artificial Sequence
  synthetic [barcode part1]
aggcactcactattct

SEQ ID NO: 33108 - DNA, 16 bp, Artificial Sequence
  synthetic [barcode part1]
ttccgactctccaatc

SEQ ID NO: 33109 - DNA, 16 bp, Artificial Sequence
  synthetic [barcode part1]
attacgaccacgacgt

SEQ ID NO: 33110 - DNA, 16 bp, Artificial Sequence
  synthetic [barcode part1]
gtagatcctgatacgc

SEQ ID NO: 33111 - DNA, 16 bp, Artificial Sequence
  synthetic [barcode part1]
ccaacaataccaggtc

SEQ ID NO: 33112 - DNA, 16 bp, Artificial Sequence
  synthetic [barcode part1]
aagttccttccaggag

SEQ ID NO: 33113 - DNA, 16 bp, Artificial Sequence
  synthetic [barcode part1]
tagtctgtcaccgaag

SEQ ID NO: 33114 - DNA, 16 bp, Artificial Sequence
  synthetic [barcode part1]
tcgcctgattcgttct

SEQ ID NO: 33115 - DNA, 16 bp, Artificial Sequence
  synthetic [barcode part1]
aggaaccacgtaccag

SEQ ID NO: 33116 - DNA, 16 bp, Artificial Sequence
  synthetic [barcode part1]
cacaactgtgcctaag

SEQ ID NO: 33117 - DNA, 16 bp, Artificial Sequence
  synthetic [barcode part1]
caacctctcgatcttc

SEQ ID NO: 33118 - DNA, 16 bp, Artificial Sequence
  synthetic [barcode part1]
gtagaggtggtgactc

SEQ ID NO: 33119 - DNA, 16 bp, Artificial Sequence
  synthetic [barcode part1]
acctatccagaactct

SEQ ID NO: 33120 - DNA, 16 bp, Artificial Sequence
  synthetic [barcode part1]
taattctgtcacgcgt

SEQ ID NO: 33121 - DNA, 16 bp, Artificial Sequence
  synthetic [barcode part1]
tagaagtgtctccacg

SEQ ID NO: 33122 - DNA, 16 bp, Artificial Sequence
  synthetic [barcode part1]
ttctccggtaggatag

SEQ ID NO: 33123 - DNA, 16 bp, Artificial Sequence
  synthetic [barcode part1]
ttgcaccgtagttcgc

SEQ ID NO: 33124 - DNA, 16 bp, Artificial Sequence
  synthetic [barcode part1]
tcgccacgtgataagt

SEQ ID NO: 33125 - DNA, 16 bp, Artificial Sequence
  synthetic [barcode part1]
tgcaatctaacggaag

SEQ ID NO: 33126 - DNA, 16 bp, Artificial Sequence
  synthetic [barcode part1]
gcaataccttcaggac

SEQ ID NO: 33127 - DNA, 16 bp, Artificial Sequence
  synthetic [barcode part1]
caacacaactgtcttc

SEQ ID NO: 33128 - DNA, 16 bp, Artificial Sequence
  synthetic [barcode part1]
gcgtccttaacaactt

SEQ ID NO: 33129 - DNA, 16 bp, Artificial Sequence
  synthetic [barcode part1]
tcgttgcctcagacac

SEQ ID NO: 33130 - DNA, 16 bp, Artificial Sequence
  synthetic [barcode part1]
cagaacgacttggacg

SEQ ID NO: 33131 - DNA, 16 bp, Artificial Sequence
  synthetic [barcode part1]
gtcaatcaggaaggag

SEQ ID NO: 33132 - DNA, 16 bp, Artificial Sequence
  synthetic [barcode part1]
tggatacttcctagtc

SEQ ID NO: 33133 - DNA, 16 bp, Artificial Sequence
  synthetic [barcode part1]
agactactcactaggc

SEQ ID NO: 33134 - DNA, 16 bp, Artificial Sequence
  synthetic [barcode part1]
cctacgcctggtaact

SEQ ID NO: 33135 - DNA, 16 bp, Artificial Sequence
  synthetic [barcode part1]
gaggtaagatactcgt

SEQ ID NO: 33136 - DNA, 16 bp, Artificial Sequence
  synthetic [barcode part1]
gcgcagttggttatac

SEQ ID NO: 33137 - DNA, 16 bp, Artificial Sequence
  synthetic [barcode part1]
ttacaccgacaatcct

SEQ ID NO: 33138 - DNA, 16 bp, Artificial Sequence
  synthetic [barcode part1]
tcggttcacctgagtc

SEQ ID NO: 33139 - DNA, 16 bp, Artificial Sequence
  synthetic [barcode part1]
aacttaggcactcctt

SEQ ID NO: 33140 - DNA, 16 bp, Artificial Sequence
  synthetic [barcode part1]
tgcgtatatcacgacg

SEQ ID NO: 33141 - DNA, 16 bp, Artificial Sequence
  synthetic [barcode part1]
tagattggccactggt

SEQ ID NO: 33142 - DNA, 16 bp, Artificial Sequence
  synthetic [barcode part1]
tgaactgactggactc

SEQ ID NO: 33143 - DNA, 16 bp, Artificial Sequence
  synthetic [barcode part1]
gtaactacgacgcact

SEQ ID NO: 33144 - DNA, 16 bp, Artificial Sequence
  synthetic [barcode part1]
gtaccgatcctgtcgt

SEQ ID NO: 33145 - DNA, 16 bp, Artificial Sequence
  synthetic [barcode part1]
tacggcgttacgatac

SEQ ID NO: 33146 - DNA, 16 bp, Artificial Sequence
  synthetic [barcode part1]
agagagtagacgtctt

SEQ ID NO: 33147 - DNA, 16 bp, Artificial Sequence
  synthetic [barcode part1]
cagttacagacgtctg

SEQ ID NO: 33148 - DNA, 16 bp, Artificial Sequence
  synthetic [barcode part1]
aggtgtcaagtggcgt

SEQ ID NO: 33149 - DNA, 16 bp, Artificial Sequence
  synthetic [barcode part1]
caaggtgtattccgtg

SEQ ID NO: 33150 - DNA, 16 bp, Artificial Sequence
  synthetic [barcode part1]
cagacgtccaagtact

SEQ ID NO: 33151 - DNA, 16 bp, Artificial Sequence
  synthetic [barcode part1]
atctcgacctctcttg

SEQ ID NO: 33152 - DNA, 16 bp, Artificial Sequence
  synthetic [barcode part1]
ccgtaattggtaccag

SEQ ID NO: 33153 - DNA, 16 bp, Artificial Sequence
  synthetic [barcode part1]
acgccttgtcgtcaac

SEQ ID NO: 33154 - DNA, 16 bp, Artificial Sequence
  synthetic [barcode part1]
tcttctacgtcctgtg

SEQ ID NO: 33155 - DNA, 16 bp, Artificial Sequence
  synthetic [barcode part1]
tgtcactctactgcct

SEQ ID NO: 33156 - DNA, 16 bp, Artificial Sequence
  synthetic [barcode part1]
gaacggagatactgcc

SEQ ID NO: 33157 - DNA, 16 bp, Artificial Sequence
  synthetic [barcode part1]
atctccgtatcctcac

SEQ ID NO: 33158 - DNA, 16 bp, Artificial Sequence
  synthetic [barcode part1]
gcctaatcgcgagaag

SEQ ID NO: 33159 - DNA, 16 bp, Artificial Sequence
  synthetic [barcode part1]
gtggaagactaccgac

SEQ ID NO: 33160 - DNA, 16 bp, Artificial Sequence
  synthetic [barcode part1]
gtgaggaatcaggtcc

SEQ ID NO: 33161 - DNA, 16 bp, Artificial Sequence
  synthetic [barcode part1]
tggttcctacacgacc

SEQ ID NO: 33162 - DNA, 16 bp, Artificial Sequence
  synthetic [barcode part1]
ttggtgacgaaggcac

SEQ ID NO: 33163 - DNA, 16 bp, Artificial Sequence
  synthetic [barcode part1]
atagacctgtactggc

SEQ ID NO: 33164 - DNA, 16 bp, Artificial Sequence
  synthetic [barcode part1]
cacaagtcctatcgcc

SEQ ID NO: 33165 - DNA, 16 bp, Artificial Sequence
  synthetic [barcode part1]
tccttctgtcagtcac

SEQ ID NO: 33166 - DNA, 16 bp, Artificial Sequence
  synthetic [barcode part1]
cgtgattccttactag

SEQ ID NO: 33167 - DNA, 16 bp, Artificial Sequence
  synthetic [barcode part1]
ttgaccagtacgtgtg

SEQ ID NO: 33168 - DNA, 16 bp, Artificial Sequence
  synthetic [barcode part1]
tcgacagagtgcgagt

SEQ ID NO: 33169 - DNA, 16 bp, Artificial Sequence
  synthetic [barcode part1]
tatccgagaagatcag

SEQ ID NO: 33170 - DNA, 16 bp, Artificial Sequence
  synthetic [barcode part1]
gtatacgcagtgttgc

SEQ ID NO: 33171 - DNA, 16 bp, Artificial Sequence
  synthetic [barcode part1]
tagattagaggcgtac

SEQ ID NO: 33172 - DNA, 16 bp, Artificial Sequence
  synthetic [barcode part1]
attggacttcgacgac

SEQ ID NO: 33173 - DNA, 16 bp, Artificial Sequence
  synthetic [barcode part1]
gtccggataaggcaac

SEQ ID NO: 33174 - DNA, 16 bp, Artificial Sequence
  synthetic [barcode part1]
caccacctatcctact

SEQ ID NO: 33175 - DNA, 16 bp, Artificial Sequence
  synthetic [barcode part1]
tcaccactgagtgtcc

SEQ ID NO: 33176 - DNA, 16 bp, Artificial Sequence
  synthetic [barcode part1]
tcttcgaacgttggtt

SEQ ID NO: 33177 - DNA, 16 bp, Artificial Sequence
  synthetic [barcode part1]
actctagaaccagtcg

SEQ ID NO: 33178 - DNA, 16 bp, Artificial Sequence
  synthetic [barcode part1]
tgcgcctattcctact

SEQ ID NO: 33179 - DNA, 16 bp, Artificial Sequence
  synthetic [barcode part1]
cgacaacggttatcgt

SEQ ID NO: 33180 - DNA, 16 bp, Artificial Sequence
  synthetic [barcode part1]
ttacgcaggaatcaag

SEQ ID NO: 33181 - DNA, 16 bp, Artificial Sequence
  synthetic [barcode part1]
gagacgtcgataattg

SEQ ID NO: 33182 - DNA, 16 bp, Artificial Sequence
  synthetic [barcode part1]
tcgaacacactgcctc

SEQ ID NO: 33183 - DNA, 16 bp, Artificial Sequence
  synthetic [barcode part1]
cggattgaccgaatct

SEQ ID NO: 33184 - DNA, 16 bp, Artificial Sequence
  synthetic [barcode part1]
ttggtactgacgtacg

SEQ ID NO: 33185 - DNA, 16 bp, Artificial Sequence
  synthetic [barcode part1]
cagaccaccaacagtt

SEQ ID NO: 33186 - DNA, 16 bp, Artificial Sequence
  synthetic [barcode part1]
cgaggaggttgtacgt

SEQ ID NO: 33187 - DNA, 16 bp, Artificial Sequence
  synthetic [barcode part1]
ttcggattccgtagag

SEQ ID NO: 33188 - DNA, 16 bp, Artificial Sequence
  synthetic [barcode part1]
gtggtcctatcctcag

SEQ ID NO: 33189 - DNA, 16 bp, Artificial Sequence
  synthetic [barcode part1]
accaacgtggatctgt

SEQ ID NO: 33190 - DNA, 16 bp, Artificial Sequence
  synthetic [barcode part1]
ttacgtgagttgagag

SEQ ID NO: 33191 - DNA, 16 bp, Artificial Sequence
  synthetic [barcode part1]
aggcacaattagactg

SEQ ID NO: 33192 - DNA, 16 bp, Artificial Sequence
  synthetic [barcode part1]
cctctgtgatacgaag

SEQ ID NO: 33193 - DNA, 16 bp, Artificial Sequence
  synthetic [barcode part1]
cctaagtaagttggag

SEQ ID NO: 33194 - DNA, 16 bp, Artificial Sequence
  synthetic [barcode part1]
agtgataggactcgcg

SEQ ID NO: 33195 - DNA, 16 bp, Artificial Sequence
  synthetic [barcode part1]
cgtgaccgttattccg

SEQ ID NO: 33196 - DNA, 16 bp, Artificial Sequence
  synthetic [barcode part1]
tgtggtgtccaaggtt

SEQ ID NO: 33197 - DNA, 16 bp, Artificial Sequence
  synthetic [barcode part1]
gcagaacagtgtccag

SEQ ID NO: 33198 - DNA, 16 bp, Artificial Sequence
  synthetic [barcode part1]
tagagtcgtacgtacc

SEQ ID NO: 33199 - DNA, 16 bp, Artificial Sequence
  synthetic [barcode part1]
cgtcagagtgattcgt

SEQ ID NO: 33200 - DNA, 16 bp, Artificial Sequence
  synthetic [barcode part1]
tgttctgtgtcgtcct

SEQ ID NO: 33201 - DNA, 16 bp, Artificial Sequence
  synthetic [barcode part1]
gacggtatctactgtg

SEQ ID NO: 33202 - DNA, 16 bp, Artificial Sequence
  synthetic [barcode part1]
tcttatccgtcgtctg

SEQ ID NO: 33203 - DNA, 16 bp, Artificial Sequence
  synthetic [barcode part1]
gcagtatattgaccgc

SEQ ID NO: 33204 - DNA, 16 bp, Artificial Sequence
  synthetic [barcode part1]
tactccgtatcacctc

SEQ ID NO: 33205 - DNA, 16 bp, Artificial Sequence
  synthetic [barcode part1]
cgatagtgattgtcgc

SEQ ID NO: 33206 - DNA, 16 bp, Artificial Sequence
  synthetic [barcode part1]
acaccttgcgtcttct

SEQ ID NO: 33207 - DNA, 16 bp, Artificial Sequence
  synthetic [barcode part1]
tgtctaggaggcagtg

SEQ ID NO: 33208 - DNA, 16 bp, Artificial Sequence
  synthetic [barcode part1]
aacgccagagatctct

SEQ ID NO: 33209 - DNA, 16 bp, Artificial Sequence
  synthetic [barcode part1]
gtgatcggtgtcgatt

SEQ ID NO: 33210 - DNA, 16 bp, Artificial Sequence
  synthetic [barcode part1]
atagattcgacaggac

SEQ ID NO: 33211 - DNA, 16 bp, Artificial Sequence
  synthetic [barcode part1]
cgatacgcaacctcct

SEQ ID NO: 33212 - DNA, 16 bp, Artificial Sequence
  synthetic [barcode part1]
tactaggtaggttgcc

SEQ ID NO: 33213 - DNA, 16 bp, Artificial Sequence
  synthetic [barcode part1]
acgagactgttcggag

SEQ ID NO: 33214 - DNA, 16 bp, Artificial Sequence
  synthetic [barcode part1]
caattaacgcgtgtgc

SEQ ID NO: 33215 - DNA, 16 bp, Artificial Sequence
  synthetic [barcode part1]
cgacgaagaacaacag

SEQ ID NO: 33216 - DNA, 16 bp, Artificial Sequence
  synthetic [barcode part1]
tcagtgtccggaagag

SEQ ID NO: 33217 - DNA, 16 bp, Artificial Sequence
  synthetic [barcode part1]
aggacaacaggtactt

SEQ ID NO: 33218 - DNA, 16 bp, Artificial Sequence
  synthetic [barcode part1]
ccaactctaccttacc

SEQ ID NO: 33219 - DNA, 16 bp, Artificial Sequence
  synthetic [barcode part1]
aggtgtgtcgacaacg

SEQ ID NO: 33220 - DNA, 16 bp, Artificial Sequence
  synthetic [barcode part1]
tggagagacgcactac

SEQ ID NO: 33221 - DNA, 16 bp, Artificial Sequence
  synthetic [barcode part1]
gcgtcggatacaatct

SEQ ID NO: 33222 - DNA, 16 bp, Artificial Sequence
  synthetic [barcode part1]
cgtactctagattgtc

SEQ ID NO: 33223 - DNA, 16 bp, Artificial Sequence
  synthetic [barcode part1]
tcaccgcgaatagtgt

SEQ ID NO: 33224 - DNA, 16 bp, Artificial Sequence
  synthetic [barcode part1]
atcttcgtgtcgagtt

SEQ ID NO: 33225 - DNA, 16 bp, Artificial Sequence
  synthetic [barcode part1]
acttctaacagttcgc

SEQ ID NO: 33226 - DNA, 16 bp, Artificial Sequence
  synthetic [barcode part1]
ttcggtaccgtactcg

SEQ ID NO: 33227 - DNA, 16 bp, Artificial Sequence
  synthetic [barcode part1]
cacctggcaatctctg

SEQ ID NO: 33228 - DNA, 16 bp, Artificial Sequence
  synthetic [barcode part1]
gaagaattctggcctc

SEQ ID NO: 33229 - DNA, 16 bp, Artificial Sequence
  synthetic [barcode part1]
attaggcgtaatccgc

SEQ ID NO: 33230 - DNA, 16 bp, Artificial Sequence
  synthetic [barcode part1]
tgttggacgaactgtc

SEQ ID NO: 33231 - DNA, 16 bp, Artificial Sequence
  synthetic [barcode part1]
ttacttcgcacggtcg

SEQ ID NO: 33232 - DNA, 16 bp, Artificial Sequence
  synthetic [barcode part1]
tggtgttacttactcg

SEQ ID NO: 33233 - DNA, 16 bp, Artificial Sequence
  synthetic [barcode part1]
tcgttatctgtagacc

SEQ ID NO: 33234 - DNA, 16 bp, Artificial Sequence
  synthetic [barcode part1]
gactgactgcaacgtt

SEQ ID NO: 33235 - DNA, 16 bp, Artificial Sequence
  synthetic [barcode part1]
tacgttggtcaacgtg

SEQ ID NO: 33236 - DNA, 16 bp, Artificial Sequence
  synthetic [barcode part1]
tagtaaccgactcggt

SEQ ID NO: 33237 - DNA, 16 bp, Artificial Sequence
  synthetic [barcode part1]
tctgtgtgtcactagt

SEQ ID NO: 33238 - DNA, 16 bp, Artificial Sequence
  synthetic [barcode part1]
gaagtctcctattcac

SEQ ID NO: 33239 - DNA, 16 bp, Artificial Sequence
  synthetic [barcode part1]
actggagtcttgatcg

SEQ ID NO: 33240 - DNA, 16 bp, Artificial Sequence
  synthetic [barcode part1]
agtccaacctccgtac

SEQ ID NO: 33241 - DNA, 16 bp, Artificial Sequence
  synthetic [barcode part1]
aggcgaatactgtggc

SEQ ID NO: 33242 - DNA, 16 bp, Artificial Sequence
  synthetic [barcode part1]
acctcgtaagtattcc

SEQ ID NO: 33243 - DNA, 16 bp, Artificial Sequence
  synthetic [barcode part1]
gtgcgtcctatcactg

SEQ ID NO: 33244 - DNA, 16 bp, Artificial Sequence
  synthetic [barcode part1]
actatctaacgtccac

SEQ ID NO: 33245 - DNA, 16 bp, Artificial Sequence
  synthetic [barcode part1]
atcactgtggtctgag

SEQ ID NO: 33246 - DNA, 16 bp, Artificial Sequence
  synthetic [barcode part1]
cacctctgtattctcg

SEQ ID NO: 33247 - DNA, 16 bp, Artificial Sequence
  synthetic [barcode part1]
ttgcgaaccgtcgttc

SEQ ID NO: 33248 - DNA, 16 bp, Artificial Sequence
  synthetic [barcode part1]
ttggaacctgcagtac

SEQ ID NO: 33249 - DNA, 16 bp, Artificial Sequence
  synthetic [barcode part1]
ttacttccgcactaag

SEQ ID NO: 33250 - DNA, 16 bp, Artificial Sequence
  synthetic [barcode part1]
ttggtgacgaactgtc

SEQ ID NO: 33251 - DNA, 16 bp, Artificial Sequence
  synthetic [barcode part1]
tccggaattcctctct

SEQ ID NO: 33252 - DNA, 16 bp, Artificial Sequence
  synthetic [barcode part1]
cacagaccgaatacct

SEQ ID NO: 33253 - DNA, 16 bp, Artificial Sequence
  synthetic [barcode part1]
aagtcgtgtctccgtc

SEQ ID NO: 33254 - DNA, 16 bp, Artificial Sequence
  synthetic [barcode part1]
gttcgtcctatagtac

SEQ ID NO: 33255 - DNA, 16 bp, Artificial Sequence
  synthetic [barcode part1]
actgtgtatcgcctcg

SEQ ID NO: 33256 - DNA, 16 bp, Artificial Sequence
  synthetic [barcode part1]
ttcggtccacgatcac

SEQ ID NO: 33257 - DNA, 16 bp, Artificial Sequence
  synthetic [barcode part1]
gaggtgaggattcgtc

SEQ ID NO: 33258 - DNA, 16 bp, Artificial Sequence
  synthetic [barcode part1]
tcgactctaagtccgc

SEQ ID NO: 33259 - DNA, 16 bp, Artificial Sequence
  synthetic [barcode part1]
aacacgttgcacaacc

SEQ ID NO: 33260 - DNA, 16 bp, Artificial Sequence
  synthetic [barcode part1]
tgcggatcagaacggt

SEQ ID NO: 33261 - DNA, 16 bp, Artificial Sequence
  synthetic [barcode part1]
agttaattgtggcgcc

SEQ ID NO: 33262 - DNA, 16 bp, Artificial Sequence
  synthetic [barcode part1]
gtaaggcaagtccgtg

SEQ ID NO: 33263 - DNA, 16 bp, Artificial Sequence
  synthetic [barcode part1]
gcactagtcttcgatt

SEQ ID NO: 33264 - DNA, 16 bp, Artificial Sequence
  synthetic [barcode part1]
attgtaacctactcgc

SEQ ID NO: 33265 - DNA, 16 bp, Artificial Sequence
  synthetic [barcode part1]
tcggtcctaggagatt

SEQ ID NO: 33266 - DNA, 16 bp, Artificial Sequence
  synthetic [barcode part1]
cacttgcgtaacgtcc

SEQ ID NO: 33267 - DNA, 16 bp, Artificial Sequence
  synthetic [barcode part1]
gcctgtctaagattct

SEQ ID NO: 33268 - DNA, 16 bp, Artificial Sequence
  synthetic [barcode part1]
attaccgccttcgcag

SEQ ID NO: 33269 - DNA, 16 bp, Artificial Sequence
  synthetic [barcode part1]
aggcctgtctagtctc

SEQ ID NO: 33270 - DNA, 16 bp, Artificial Sequence
  synthetic [barcode part1]
tgccttaccgtcttgt

SEQ ID NO: 33271 - DNA, 16 bp, Artificial Sequence
  synthetic [barcode part1]
gtggaccgttaccttc

SEQ ID NO: 33272 - DNA, 16 bp, Artificial Sequence
  synthetic [barcode part1]
cgaagtctacgtacgt

SEQ ID NO: 33273 - DNA, 16 bp, Artificial Sequence
  synthetic [barcode part1]
ttaccacacttcgcct

SEQ ID NO: 33274 - DNA, 16 bp, Artificial Sequence
  synthetic [barcode part1]
gtcttgtggatactct

SEQ ID NO: 33275 - DNA, 16 bp, Artificial Sequence
  synthetic [barcode part1]
tgtcactgacgtatct

SEQ ID NO: 33276 - DNA, 16 bp, Artificial Sequence
  synthetic [barcode part1]
gcctaggatctcgttc

SEQ ID NO: 33277 - DNA, 16 bp, Artificial Sequence
  synthetic [barcode part1]
tccaagaatcgactgc

SEQ ID NO: 33278 - DNA, 16 bp, Artificial Sequence
  synthetic [barcode part1]
tcttcggtagttgcgc

SEQ ID NO: 33279 - DNA, 16 bp, Artificial Sequence
  synthetic [barcode part1]
agtaggcaacaggtag

SEQ ID NO: 33280 - DNA, 16 bp, Artificial Sequence
  synthetic [barcode part1]
gttaccacgataaccg

SEQ ID NO: 33281 - DNA, 16 bp, Artificial Sequence
  synthetic [barcode part1]
gatctcactacctgcg

SEQ ID NO: 33282 - DNA, 16 bp, Artificial Sequence
  synthetic [barcode part1]
tatcaccaggtatcct

SEQ ID NO: 33283 - DNA, 16 bp, Artificial Sequence
  synthetic [barcode part1]
cctatagtctgttacg

SEQ ID NO: 33284 - DNA, 16 bp, Artificial Sequence
  synthetic [barcode part1]
agatcacactcgacac

SEQ ID NO: 33285 - DNA, 16 bp, Artificial Sequence
  synthetic [barcode part1]
caggtcacctctgtgt

SEQ ID NO: 33286 - DNA, 16 bp, Artificial Sequence
  synthetic [barcode part1]
taccaggtcgtcaagt

SEQ ID NO: 33287 - DNA, 16 bp, Artificial Sequence
  synthetic [barcode part1]
cggtcttacaccagtc

SEQ ID NO: 33288 - DNA, 16 bp, Artificial Sequence
  synthetic [barcode part1]
tacacactaatcggcg

SEQ ID NO: 33289 - DNA, 16 bp, Artificial Sequence
  synthetic [barcode part1]
gtacctcttcttgcac

SEQ ID NO: 33290 - DNA, 16 bp, Artificial Sequence
  synthetic [barcode part1]
acagatccgatagaac

SEQ ID NO: 33291 - DNA, 16 bp, Artificial Sequence
  synthetic [barcode part1]
tctctctgaccgattc

SEQ ID NO: 33292 - DNA, 16 bp, Artificial Sequence
  synthetic [barcode part1]
tctcacggccactaac

SEQ ID NO: 33293 - DNA, 16 bp, Artificial Sequence
  synthetic [barcode part1]
cctctggaactcttct

SEQ ID NO: 33294 - DNA, 16 bp, Artificial Sequence
  synthetic [barcode part1]
tagtcaacggtcggtt

SEQ ID NO: 33295 - DNA, 16 bp, Artificial Sequence
  synthetic [barcode part1]
tggtaactgcgtctcc

SEQ ID NO: 33296 - DNA, 16 bp, Artificial Sequence
  synthetic [barcode part1]
gttacggatccgcctt

SEQ ID NO: 33297 - DNA, 16 bp, Artificial Sequence
  synthetic [barcode part1]
ttgttgttgccactcc

SEQ ID NO: 33298 - DNA, 16 bp, Artificial Sequence
  synthetic [barcode part1]
gtccaaggcaataagt

SEQ ID NO: 33299 - DNA, 16 bp, Artificial Sequence
  synthetic [barcode part1]
ccttcagtgtgtggtc

SEQ ID NO: 33300 - DNA, 16 bp, Artificial Sequence
  synthetic [barcode part1]
aacggagacgtagtcc

SEQ ID NO: 33301 - DNA, 16 bp, Artificial Sequence
  synthetic [barcode part1]
atacgaccacgtagtc

SEQ ID NO: 33302 - DNA, 16 bp, Artificial Sequence
  synthetic [barcode part1]
tacggccgtcaagaag

SEQ ID NO: 33303 - DNA, 16 bp, Artificial Sequence
  synthetic [barcode part1]
tgtgaacggcgagatc

SEQ ID NO: 33304 - DNA, 16 bp, Artificial Sequence
  synthetic [barcode part1]
ccttcgaactggtacc

SEQ ID NO: 33305 - DNA, 16 bp, Artificial Sequence
  synthetic [barcode part1]
aggaataacttgacgc

SEQ ID NO: 33306 - DNA, 16 bp, Artificial Sequence
  synthetic [barcode part1]
cagaatcaccgactac

SEQ ID NO: 33307 - DNA, 16 bp, Artificial Sequence
  synthetic [barcode part1]
cgtacttctcggcagt

SEQ ID NO: 33308 - DNA, 16 bp, Artificial Sequence
  synthetic [barcode part1]
aatccttccgacgtgc

SEQ ID NO: 33309 - DNA, 16 bp, Artificial Sequence
  synthetic [barcode part1]
aacactgtgactggtc

SEQ ID NO: 33310 - DNA, 16 bp, Artificial Sequence
  synthetic [barcode part1]
tgaggcaaggcacttg

SEQ ID NO: 33311 - DNA, 16 bp, Artificial Sequence
  synthetic [barcode part1]
cgcacagaatacactc

SEQ ID NO: 33312 - DNA, 16 bp, Artificial Sequence
  synthetic [barcode part1]
gatctaatcggcggtt

SEQ ID NO: 33313 - DNA, 16 bp, Artificial Sequence
  synthetic [barcode part1]
ttcagagatcacggtc

SEQ ID NO: 33314 - DNA, 16 bp, Artificial Sequence
  synthetic [barcode part1]
gaccacgaatctctcc

SEQ ID NO: 33315 - DNA, 16 bp, Artificial Sequence
  synthetic [barcode part1]
tagtgacgtcaccaac

SEQ ID NO: 33316 - DNA, 16 bp, Artificial Sequence
  synthetic [barcode part1]
cgaagacttgtactcg

SEQ ID NO: 33317 - DNA, 16 bp, Artificial Sequence
  synthetic [barcode part1]
cagtaggcagagtaag

SEQ ID NO: 33318 - DNA, 16 bp, Artificial Sequence
  synthetic [barcode part1]
tcaacgtgttggtacg

SEQ ID NO: 33319 - DNA, 16 bp, Artificial Sequence
  synthetic [barcode part1]
tgcgcaagtaggacgt

SEQ ID NO: 33320 - DNA, 16 bp, Artificial Sequence
  synthetic [barcode part1]
taaccactctaactcg

SEQ ID NO: 33321 - DNA, 16 bp, Artificial Sequence
  synthetic [barcode part1]
aatcacggacctctcc

SEQ ID NO: 33322 - DNA, 16 bp, Artificial Sequence
  synthetic [barcode part1]
tatcgccagatatctc

SEQ ID NO: 33323 - DNA, 16 bp, Artificial Sequence
  synthetic [barcode part1]
gcaacagagacacctg

SEQ ID NO: 33324 - DNA, 16 bp, Artificial Sequence
  synthetic [barcode part1]
tgtgtcagaggaaccg

SEQ ID NO: 33325 - DNA, 16 bp, Artificial Sequence
  synthetic [barcode part1]
gatcacaatcggtgtc

SEQ ID NO: 33326 - DNA, 16 bp, Artificial Sequence
  synthetic [barcode part1]
taagtatctctcggtc

SEQ ID NO: 33327 - DNA, 16 bp, Artificial Sequence
  synthetic [barcode part1]
tcaacacggagttaag

SEQ ID NO: 33328 - DNA, 16 bp, Artificial Sequence
  synthetic [barcode part1]
aagttaggccagtgcg

SEQ ID NO: 33329 - DNA, 16 bp, Artificial Sequence
  synthetic [barcode part1]
cggtgtgtaatagaac

SEQ ID NO: 33330 - DNA, 16 bp, Artificial Sequence
  synthetic [barcode part1]
tgtagtcttggcgtag

SEQ ID NO: 33331 - DNA, 16 bp, Artificial Sequence
  synthetic [barcode part1]
ccgtctagagttccac

SEQ ID NO: 33332 - DNA, 16 bp, Artificial Sequence
  synthetic [barcode part1]
gttcctgttcaacaac

SEQ ID NO: 33333 - DNA, 16 bp, Artificial Sequence
  synthetic [barcode part1]
agacgccgataaggtc

SEQ ID NO: 33334 - DNA, 16 bp, Artificial Sequence
  synthetic [barcode part1]
aaccacttccagtgag

SEQ ID NO: 33335 - DNA, 16 bp, Artificial Sequence
  synthetic [barcode part1]
acaatagatagtcgcg

SEQ ID NO: 33336 - DNA, 16 bp, Artificial Sequence
  synthetic [barcode part1]
aggcacctgttacctc

SEQ ID NO: 33337 - DNA, 16 bp, Artificial Sequence
  synthetic [barcode part1]
tcttggccttctagtc

SEQ ID NO: 33338 - DNA, 16 bp, Artificial Sequence
  synthetic [barcode part1]
aaggacgttcgataac

SEQ ID NO: 33339 - DNA, 16 bp, Artificial Sequence
  synthetic [barcode part1]
gaggtacgttgttaag

SEQ ID NO: 33340 - DNA, 16 bp, Artificial Sequence
  synthetic [barcode part1]
acgccaatcagtacgt

SEQ ID NO: 33341 - DNA, 16 bp, Artificial Sequence
  synthetic [barcode part1]
tctatcggatctgtgt

SEQ ID NO: 33342 - DNA, 16 bp, Artificial Sequence
  synthetic [barcode part1]
agattgatcggtctcg

SEQ ID NO: 33343 - DNA, 16 bp, Artificial Sequence
  synthetic [barcode part1]
ttgccgcgtaataggt

SEQ ID NO: 33344 - DNA, 16 bp, Artificial Sequence
  synthetic [barcode part1]
ttcctgagtgttgact

SEQ ID NO: 33345 - DNA, 16 bp, Artificial Sequence
  synthetic [barcode part1]
cggcagtagtctaatc

SEQ ID NO: 33346 - DNA, 16 bp, Artificial Sequence
  synthetic [barcode part1]
acaaggacgtgaaggt

SEQ ID NO: 33347 - DNA, 16 bp, Artificial Sequence
  synthetic [barcode part1]
cggtccttgcgtaact

SEQ ID NO: 33348 - DNA, 16 bp, Artificial Sequence
  synthetic [barcode part1]
agaagattgtcggcgc

SEQ ID NO: 33349 - DNA, 16 bp, Artificial Sequence
  synthetic [barcode part1]
tgagtcagttgttggc

SEQ ID NO: 33350 - DNA, 16 bp, Artificial Sequence
  synthetic [barcode part1]
atagtaggcaaccgcg

SEQ ID NO: 33351 - DNA, 16 bp, Artificial Sequence
  synthetic [barcode part1]
gtggttattgaaggac

SEQ ID NO: 33352 - DNA, 16 bp, Artificial Sequence
  synthetic [barcode part1]
cgagtgttacgtcagt

SEQ ID NO: 33353 - DNA, 16 bp, Artificial Sequence
  synthetic [barcode part1]
gtacttctgcggaagt

SEQ ID NO: 33354 - DNA, 16 bp, Artificial Sequence
  synthetic [barcode part1]
acgtagtgagagattc

SEQ ID NO: 33355 - DNA, 16 bp, Artificial Sequence
  synthetic [barcode part1]
tgcctctactagaccg

SEQ ID NO: 33356 - DNA, 16 bp, Artificial Sequence
  synthetic [barcode part1]
acaactgtgcacagtc

SEQ ID NO: 33357 - DNA, 16 bp, Artificial Sequence
  synthetic [barcode part1]
cgtcaggtaagttacc

SEQ ID NO: 33358 - DNA, 16 bp, Artificial Sequence
  synthetic [barcode part1]
cgatatcttgttcgtg

SEQ ID NO: 33359 - DNA, 16 bp, Artificial Sequence
  synthetic [barcode part1]
gatcaggtattggtag

SEQ ID NO: 33360 - DNA, 16 bp, Artificial Sequence
  synthetic [barcode part1]
gacaactcggtagttc

SEQ ID NO: 33361 - DNA, 16 bp, Artificial Sequence
  synthetic [barcode part1]
taggatatcaccaccg

SEQ ID NO: 33362 - DNA, 16 bp, Artificial Sequence
  synthetic [barcode part1]
attctacggactaggc

SEQ ID NO: 33363 - DNA, 16 bp, Artificial Sequence
  synthetic [barcode part1]
tgacggttagtctggt

SEQ ID NO: 33364 - DNA, 16 bp, Artificial Sequence
  synthetic [barcode part1]
aatagtgtggacgccg

SEQ ID NO: 33365 - DNA, 16 bp, Artificial Sequence
  synthetic [barcode part1]
gcgcctagaataatag

SEQ ID NO: 33366 - DNA, 16 bp, Artificial Sequence
  synthetic [barcode part1]
tattacacgcagtgcg

SEQ ID NO: 33367 - DNA, 16 bp, Artificial Sequence
  synthetic [barcode part1]
gtgtcagacacgactt

SEQ ID NO: 33368 - DNA, 16 bp, Artificial Sequence
  synthetic [barcode part1]
ttgagtgttactctgc

SEQ ID NO: 33369 - DNA, 16 bp, Artificial Sequence
  synthetic [barcode part1]
gtccgttagtatcgcc

SEQ ID NO: 33370 - DNA, 16 bp, Artificial Sequence
  synthetic [barcode part1]
gattccagacgttacg

SEQ ID NO: 33371 - DNA, 16 bp, Artificial Sequence
  synthetic [barcode part1]
taaggcggcaatcgtg

SEQ ID NO: 33372 - DNA, 16 bp, Artificial Sequence
  synthetic [barcode part1]
gcctatcgtagtgtcc

SEQ ID NO: 33373 - DNA, 16 bp, Artificial Sequence
  synthetic [barcode part1]
acctgtaacgcaactg

SEQ ID NO: 33374 - DNA, 16 bp, Artificial Sequence
  synthetic [barcode part1]
actagaactgactccg

SEQ ID NO: 33375 - DNA, 16 bp, Artificial Sequence
  synthetic [barcode part1]
tcagtcctaggaagtc

SEQ ID NO: 33376 - DNA, 16 bp, Artificial Sequence
  synthetic [barcode part1]
tgcacagtgttggtgt

SEQ ID NO: 33377 - DNA, 16 bp, Artificial Sequence
  synthetic [barcode part1]
tctaatctctctcggc

SEQ ID NO: 33378 - DNA, 16 bp, Artificial Sequence
  synthetic [barcode part1]
tgaattgttcctgcgt

SEQ ID NO: 33379 - DNA, 16 bp, Artificial Sequence
  synthetic [barcode part1]
aaccgtaactgtacgc

SEQ ID NO: 33380 - DNA, 16 bp, Artificial Sequence
  synthetic [barcode part1]
gtctgattcctgcgtg

SEQ ID NO: 33381 - DNA, 16 bp, Artificial Sequence
  synthetic [barcode part1]
tcttctcaactctggc

SEQ ID NO: 33382 - DNA, 16 bp, Artificial Sequence
  synthetic [barcode part1]
gaccagttcaggactt

SEQ ID NO: 33383 - DNA, 16 bp, Artificial Sequence
  synthetic [barcode part1]
cgcgtgaataagatac

SEQ ID NO: 33384 - DNA, 16 bp, Artificial Sequence
  synthetic [barcode part1]
tggtgcaccggatatt

SEQ ID NO: 33385 - DNA, 16 bp, Artificial Sequence
  synthetic [barcode part1]
tccacaagacgtctag

SEQ ID NO: 33386 - DNA, 16 bp, Artificial Sequence
  synthetic [barcode part1]
caaccgataaccggtt

SEQ ID NO: 33387 - DNA, 16 bp, Artificial Sequence
  synthetic [barcode part1]
accaacgagtgtacct

SEQ ID NO: 33388 - DNA, 16 bp, Artificial Sequence
  synthetic [barcode part1]
gacacgcaactcttcc

SEQ ID NO: 33389 - DNA, 16 bp, Artificial Sequence
  synthetic [barcode part1]
tctcaagtactcgttg

SEQ ID NO: 33390 - DNA, 16 bp, Artificial Sequence
  synthetic [barcode part1]
cgataactcaacggtc

SEQ ID NO: 33391 - DNA, 16 bp, Artificial Sequence
  synthetic [barcode part1]
accgaacctatcgagt

SEQ ID NO: 33392 - DNA, 16 bp, Artificial Sequence
  synthetic [barcode part1]
gagtaccgttccgtct

SEQ ID NO: 33393 - DNA, 16 bp, Artificial Sequence
  synthetic [barcode part1]
tagacactgacgaggc

SEQ ID NO: 33394 - DNA, 16 bp, Artificial Sequence
  synthetic [barcode part1]
tataatcgaagtggcg

SEQ ID NO: 33395 - DNA, 16 bp, Artificial Sequence
  synthetic [barcode part1]
gttacacttggacgtg

SEQ ID NO: 33396 - DNA, 16 bp, Artificial Sequence
  synthetic [barcode part1]
aagttcgtaccgacac

SEQ ID NO: 33397 - DNA, 16 bp, Artificial Sequence
  synthetic [barcode part1]
gattcgttcactctag

SEQ ID NO: 33398 - DNA, 16 bp, Artificial Sequence
  synthetic [barcode part1]
ttccacgtgtaccttc

SEQ ID NO: 33399 - DNA, 16 bp, Artificial Sequence
  synthetic [barcode part1]
gatcggtccgattagt

SEQ ID NO: 33400 - DNA, 16 bp, Artificial Sequence
  synthetic [barcode part1]
ccaacagattcggtgt

SEQ ID NO: 33401 - DNA, 16 bp, Artificial Sequence
  synthetic [barcode part1]
gcagtcaattacgcgt

SEQ ID NO: 33402 - DNA, 16 bp, Artificial Sequence
  synthetic [barcode part1]
gtcctatcaccgacgt

SEQ ID NO: 33403 - DNA, 16 bp, Artificial Sequence
  synthetic [barcode part1]
agtgcacaggactggt

SEQ ID NO: 33404 - DNA, 16 bp, Artificial Sequence
  synthetic [barcode part1]
gcaatactaacgccac

SEQ ID NO: 33405 - DNA, 16 bp, Artificial Sequence
  synthetic [barcode part1]
tcaggtgactcacagt

SEQ ID NO: 33406 - DNA, 16 bp, Artificial Sequence
  synthetic [barcode part1]
cgaccagaactaatcc

SEQ ID NO: 33407 - DNA, 16 bp, Artificial Sequence
  synthetic [barcode part1]
atctggttggttcgag

SEQ ID NO: 33408 - DNA, 16 bp, Artificial Sequence
  synthetic [barcode part1]
aggtatacctcgtacg

SEQ ID NO: 33409 - DNA, 16 bp, Artificial Sequence
  synthetic [barcode part1]
ttgcctcctgagtgtg

SEQ ID NO: 33410 - DNA, 16 bp, Artificial Sequence
  synthetic [barcode part1]
gagtgccttgtgaatc

SEQ ID NO: 33411 - DNA, 16 bp, Artificial Sequence
  synthetic [barcode part1]
acgcctcaacctaatt

SEQ ID NO: 33412 - DNA, 16 bp, Artificial Sequence
  synthetic [barcode part1]
gcctctggtaagagtt

SEQ ID NO: 33413 - DNA, 16 bp, Artificial Sequence
  synthetic [barcode part1]
atcgtgacttattcgc

SEQ ID NO: 33414 - DNA, 16 bp, Artificial Sequence
  synthetic [barcode part1]
gtcttgcctgttactc

SEQ ID NO: 33415 - DNA, 16 bp, Artificial Sequence
  synthetic [barcode part1]
acacgcgattaaccac

SEQ ID NO: 33416 - DNA, 16 bp, Artificial Sequence
  synthetic [barcode part1]
aagtcctaggatcctg

SEQ ID NO: 33417 - DNA, 16 bp, Artificial Sequence
  synthetic [barcode part1]
aatccacacttcgccg

SEQ ID NO: 33418 - DNA, 16 bp, Artificial Sequence
  synthetic [barcode part1]
ttgacaacttgcacct

SEQ ID NO: 33419 - DNA, 16 bp, Artificial Sequence
  synthetic [barcode part1]
tctatcggtacgatct

SEQ ID NO: 33420 - DNA, 16 bp, Artificial Sequence
  synthetic [barcode part1]
taggaggttggaagac

SEQ ID NO: 33421 - DNA, 16 bp, Artificial Sequence
  synthetic [barcode part1]
ataacgcgagactctc

SEQ ID NO: 33422 - DNA, 16 bp, Artificial Sequence
  synthetic [barcode part1]
gtgtgcgtgatatcac

SEQ ID NO: 33423 - DNA, 16 bp, Artificial Sequence
  synthetic [barcode part1]
tgtgagtgtcctgtcc

SEQ ID NO: 33424 - DNA, 16 bp, Artificial Sequence
  synthetic [barcode part1]
caggaggattacgcgt

SEQ ID NO: 33425 - DNA, 16 bp, Artificial Sequence
  synthetic [barcode part1]
gcagtgaccacacaag

SEQ ID NO: 33426 - DNA, 16 bp, Artificial Sequence
  synthetic [barcode part1]
ataacgtcggccaact

SEQ ID NO: 33427 - DNA, 16 bp, Artificial Sequence
  synthetic [barcode part1]
ttacgagttcggcctc

SEQ ID NO: 33428 - DNA, 16 bp, Artificial Sequence
  synthetic [barcode part1]
gcggccgttctaattc

SEQ ID NO: 33429 - DNA, 16 bp, Artificial Sequence
  synthetic [barcode part1]
aattcctcgcactaac

SEQ ID NO: 33430 - DNA, 16 bp, Artificial Sequence
  synthetic [barcode part1]
agaaccgtgtaggtcg

SEQ ID NO: 33431 - DNA, 16 bp, Artificial Sequence
  synthetic [barcode part1]
gccttcgttattaggt

SEQ ID NO: 33432 - DNA, 16 bp, Artificial Sequence
  synthetic [barcode part1]
gtggccgagtcttctt

SEQ ID NO: 33433 - DNA, 16 bp, Artificial Sequence
  synthetic [barcode part1]
tattcggaccgccttg

SEQ ID NO: 33434 - DNA, 16 bp, Artificial Sequence
  synthetic [barcode part1]
gcactaagattgcgtc

SEQ ID NO: 33435 - DNA, 16 bp, Artificial Sequence
  synthetic [barcode part1]
actgtccacttacaac

SEQ ID NO: 33436 - DNA, 16 bp, Artificial Sequence
  synthetic [barcode part1]
ttgtgtgcctcggttg

SEQ ID NO: 33437 - DNA, 16 bp, Artificial Sequence
  synthetic [barcode part1]
tggtccgataatccag

SEQ ID NO: 33438 - DNA, 16 bp, Artificial Sequence
  synthetic [barcode part1]
tcagtgtcacagtcag

SEQ ID NO: 33439 - DNA, 16 bp, Artificial Sequence
  synthetic [barcode part1]
tccggcctatacaacc

SEQ ID NO: 33440 - DNA, 16 bp, Artificial Sequence
  synthetic [barcode part1]
caagttcgtcttatcg

SEQ ID NO: 33441 - DNA, 16 bp, Artificial Sequence
  synthetic [barcode part1]
tcaactctagacctgt

SEQ ID NO: 33442 - DNA, 16 bp, Artificial Sequence
  synthetic [barcode part1]
cgattacggtataccg

SEQ ID NO: 33443 - DNA, 16 bp, Artificial Sequence
  synthetic [barcode part1]
aatccttgagacggtc

SEQ ID NO: 33444 - DNA, 16 bp, Artificial Sequence
  synthetic [barcode part1]
tacgagtcaccgttcc

SEQ ID NO: 33445 - DNA, 16 bp, Artificial Sequence
  synthetic [barcode part1]
taattccgtgcactac

SEQ ID NO: 33446 - DNA, 16 bp, Artificial Sequence
  synthetic [barcode part1]
tcgtgttggcggtctt

SEQ ID NO: 33447 - DNA, 16 bp, Artificial Sequence
  synthetic [barcode part1]
gagttcgtccacaagt

SEQ ID NO: 33448 - DNA, 16 bp, Artificial Sequence
  synthetic [barcode part1]
gagtgcaattactgag

SEQ ID NO: 33449 - DNA, 16 bp, Artificial Sequence
  synthetic [barcode part1]
agattgtggtacgagt

SEQ ID NO: 33450 - DNA, 16 bp, Artificial Sequence
  synthetic [barcode part1]
ttgcactgacgatctt

SEQ ID NO: 33451 - DNA, 16 bp, Artificial Sequence
  synthetic [barcode part1]
acttcacgcgaccact

SEQ ID NO: 33452 - DNA, 16 bp, Artificial Sequence
  synthetic [barcode part1]
gatacgcaatcagagt

SEQ ID NO: 33453 - DNA, 16 bp, Artificial Sequence
  synthetic [barcode part1]
gatccaattggcaacc

SEQ ID NO: 33454 - DNA, 16 bp, Artificial Sequence
  synthetic [barcode part1]
aagaggcgatacgtcc

SEQ ID NO: 33455 - DNA, 16 bp, Artificial Sequence
  synthetic [barcode part1]
aagacgatccgtcact

SEQ ID NO: 33456 - DNA, 16 bp, Artificial Sequence
  synthetic [barcode part1]
tgtcggaagatacagt

SEQ ID NO: 33457 - DNA, 16 bp, Artificial Sequence
  synthetic [barcode part1]
gcacgtactagtcagt

SEQ ID NO: 33458 - DNA, 16 bp, Artificial Sequence
  synthetic [barcode part1]
caacgcgtaattcttc

SEQ ID NO: 33459 - DNA, 16 bp, Artificial Sequence
  synthetic [barcode part1]
caagaagtcctgacct

SEQ ID NO: 33460 - DNA, 16 bp, Artificial Sequence
  synthetic [barcode part1]
ccgatatactggtacg

SEQ ID NO: 33461 - DNA, 16 bp, Artificial Sequence
  synthetic [barcode part1]
gtctgagttcactgtt

SEQ ID NO: 33462 - DNA, 16 bp, Artificial Sequence
  synthetic [barcode part1]
gtgaccaaccaacact

SEQ ID NO: 33463 - DNA, 16 bp, Artificial Sequence
  synthetic [barcode part1]
tcgtagatattccgtc

SEQ ID NO: 33464 - DNA, 16 bp, Artificial Sequence
  synthetic [barcode part1]
cgacgattcgacaact

SEQ ID NO: 33465 - DNA, 16 bp, Artificial Sequence
  synthetic [barcode part1]
ttacaccgtgacttgt

SEQ ID NO: 33466 - DNA, 16 bp, Artificial Sequence
  synthetic [barcode part1]
agaggacgaattggac

SEQ ID NO: 33467 - DNA, 16 bp, Artificial Sequence
  synthetic [barcode part1]
aatcttccggtcttcc

SEQ ID NO: 33468 - DNA, 16 bp, Artificial Sequence
  synthetic [barcode part1]
gaatcctccgaagttg

SEQ ID NO: 33469 - DNA, 16 bp, Artificial Sequence
  synthetic [barcode part1]
gaggagtcgaatctgc

SEQ ID NO: 33470 - DNA, 16 bp, Artificial Sequence
  synthetic [barcode part1]
ttgatctagaccggac

SEQ ID NO: 33471 - DNA, 16 bp, Artificial Sequence
  synthetic [barcode part1]
cgccgttcactaacgt

SEQ ID NO: 33472 - DNA, 16 bp, Artificial Sequence
  synthetic [barcode part1]
ttgattaggccaaccg

SEQ ID NO: 33473 - DNA, 16 bp, Artificial Sequence
  synthetic [barcode part1]
tcacagtaagacctcg

SEQ ID NO: 33474 - DNA, 16 bp, Artificial Sequence
  synthetic [barcode part1]
gcaattgtaacgcgtc

SEQ ID NO: 33475 - DNA, 16 bp, Artificial Sequence
  synthetic [barcode part1]
ttcaggttctaactcg

SEQ ID NO: 33476 - DNA, 16 bp, Artificial Sequence
  synthetic [barcode part1]
aggatcgagtcacacg

SEQ ID NO: 33477 - DNA, 16 bp, Artificial Sequence
  synthetic [barcode part1]
aagttatcgagagtgc

SEQ ID NO: 33478 - DNA, 16 bp, Artificial Sequence
  synthetic [barcode part1]
ccgacgaattcttgcc

SEQ ID NO: 33479 - DNA, 16 bp, Artificial Sequence
  synthetic [barcode part1]
acctgtcgcagtatcc

SEQ ID NO: 33480 - DNA, 16 bp, Artificial Sequence
  synthetic [barcode part1]
ttacgaaccgtacggt

SEQ ID NO: 33481 - DNA, 16 bp, Artificial Sequence
  synthetic [barcode part1]
ataccttctggaccgc

SEQ ID NO: 33482 - DNA, 16 bp, Artificial Sequence
  synthetic [barcode part1]
aacctcacctacttag

SEQ ID NO: 33483 - DNA, 16 bp, Artificial Sequence
  synthetic [barcode part1]
cactcgcaataggtgt

SEQ ID NO: 33484 - DNA, 16 bp, Artificial Sequence
  synthetic [barcode part1]
cgaagagttgaccttc

SEQ ID NO: 33485 - DNA, 16 bp, Artificial Sequence
  synthetic [barcode part1]
accttgtggcgatagt

SEQ ID NO: 33486 - DNA, 16 bp, Artificial Sequence
  synthetic [barcode part1]
acgaactccttgttac

SEQ ID NO: 33487 - DNA, 16 bp, Artificial Sequence
  synthetic [barcode part1]
aagacgcaactactag

SEQ ID NO: 33488 - DNA, 16 bp, Artificial Sequence
  synthetic [barcode part1]
ttccggcacacgactt

SEQ ID NO: 33489 - DNA, 16 bp, Artificial Sequence
  synthetic [barcode part1]
tggaatcaccgatcac

SEQ ID NO: 33490 - DNA, 16 bp, Artificial Sequence
  synthetic [barcode part1]
ttgtccgaatatcgtc

SEQ ID NO: 33491 - DNA, 16 bp, Artificial Sequence
  synthetic [barcode part1]
taattgtgcggttgcg

SEQ ID NO: 33492 - DNA, 16 bp, Artificial Sequence
  synthetic [barcode part1]
accttccgattgagag

SEQ ID NO: 33493 - DNA, 16 bp, Artificial Sequence
  synthetic [barcode part1]
ttagacgtcgtcctgc

SEQ ID NO: 33494 - DNA, 16 bp, Artificial Sequence
  synthetic [barcode part1]
agattgaattggtgcg

SEQ ID NO: 33495 - DNA, 16 bp, Artificial Sequence
  synthetic [barcode part1]
gaccttctgtactaac

SEQ ID NO: 33496 - DNA, 16 bp, Artificial Sequence
  synthetic [barcode part1]
ttgacactcagttctg

SEQ ID NO: 33497 - DNA, 16 bp, Artificial Sequence
  synthetic [barcode part1]
acacggtcacgtgatt

SEQ ID NO: 33498 - DNA, 16 bp, Artificial Sequence
  synthetic [barcode part1]
gtgactaatacaccgc

SEQ ID NO: 33499 - DNA, 16 bp, Artificial Sequence
  synthetic [barcode part1]
gtacggttctctcggt

SEQ ID NO: 33500 - DNA, 16 bp, Artificial Sequence
  synthetic [barcode part1]
tacggcacttgaggtt

SEQ ID NO: 33501 - DNA, 16 bp, Artificial Sequence
  synthetic [barcode part1]
caggagacgtgtgatc

SEQ ID NO: 33502 - DNA, 16 bp, Artificial Sequence
  synthetic [barcode part1]
gttgactcacagtacg

SEQ ID NO: 33503 - DNA, 16 bp, Artificial Sequence
  synthetic [barcode part1]
tacacttgtagaggcc

SEQ ID NO: 33504 - DNA, 16 bp, Artificial Sequence
  synthetic [barcode part1]
gagaagtacctgaact

SEQ ID NO: 33505 - DNA, 16 bp, Artificial Sequence
  synthetic [barcode part1]
cagtgtactctactac

SEQ ID NO: 33506 - DNA, 16 bp, Artificial Sequence
  synthetic [barcode part1]
tggcgtgatcaccttc

SEQ ID NO: 33507 - DNA, 16 bp, Artificial Sequence
  synthetic [barcode part1]
tgcagtaagatctcgc

SEQ ID NO: 33508 - DNA, 16 bp, Artificial Sequence
  synthetic [barcode part1]
tctctaatccttcggc

SEQ ID NO: 33509 - DNA, 16 bp, Artificial Sequence
  synthetic [barcode part1]
tctggaacgactgatc

SEQ ID NO: 33510 - DNA, 16 bp, Artificial Sequence
  synthetic [barcode part1]
cagtctccacgtgatc

SEQ ID NO: 33511 - DNA, 16 bp, Artificial Sequence
  synthetic [barcode part1]
caagtacctgaacgtc

SEQ ID NO: 33512 - DNA, 16 bp, Artificial Sequence
  synthetic [barcode part1]
aaggtaactacagacc

SEQ ID NO: 33513 - DNA, 16 bp, Artificial Sequence
  synthetic [barcode part1]
tgtggcggaacagatc

SEQ ID NO: 33514 - DNA, 16 bp, Artificial Sequence
  synthetic [barcode part1]
ttcctctgcgttgtac

SEQ ID NO: 33515 - DNA, 16 bp, Artificial Sequence
  synthetic [barcode part1]
tgtgtggacctctcgt

SEQ ID NO: 33516 - DNA, 16 bp, Artificial Sequence
  synthetic [barcode part1]
cgcaccttcgtatctt

SEQ ID NO: 33517 - DNA, 16 bp, Artificial Sequence
  synthetic [barcode part1]
ttctggttataccggt

SEQ ID NO: 33518 - DNA, 16 bp, Artificial Sequence
  synthetic [barcode part1]
cgagtgaagtgttgcg

SEQ ID NO: 33519 - DNA, 16 bp, Artificial Sequence
  synthetic [barcode part1]
atctacgttctgtcag

SEQ ID NO: 33520 - DNA, 16 bp, Artificial Sequence
  synthetic [barcode part1]
ccttacgttctcacac

SEQ ID NO: 33521 - DNA, 16 bp, Artificial Sequence
  synthetic [barcode part1]
gaaggatccgtgtggt

SEQ ID NO: 33522 - DNA, 16 bp, Artificial Sequence
  synthetic [barcode part1]
ttaggaccacttactc

SEQ ID NO: 33523 - DNA, 16 bp, Artificial Sequence
  synthetic [barcode part1]
tagaatcgtcggtcgt

SEQ ID NO: 33524 - DNA, 16 bp, Artificial Sequence
  synthetic [barcode part1]
atccttagaacacggc

SEQ ID NO: 33525 - DNA, 16 bp, Artificial Sequence
  synthetic [barcode part1]
cgagacacttaatccg

SEQ ID NO: 33526 - DNA, 16 bp, Artificial Sequence
  synthetic [barcode part1]
caattggcgtaacgtc

SEQ ID NO: 33527 - DNA, 16 bp, Artificial Sequence
  synthetic [barcode part1]
aattgcggtataccgc

SEQ ID NO: 33528 - DNA, 16 bp, Artificial Sequence
  synthetic [barcode part1]
agttccacaggtggag

SEQ ID NO: 33529 - DNA, 16 bp, Artificial Sequence
  synthetic [barcode part1]
attacctcctactgcc

SEQ ID NO: 33530 - DNA, 16 bp, Artificial Sequence
  synthetic [barcode part1]
ttcacacggcctgact

SEQ ID NO: 33531 - DNA, 16 bp, Artificial Sequence
  synthetic [barcode part1]
gcaattggagactggc

SEQ ID NO: 33532 - DNA, 16 bp, Artificial Sequence
  synthetic [barcode part1]
ttaagatatccgcctc

SEQ ID NO: 33533 - DNA, 16 bp, Artificial Sequence
  synthetic [barcode part1]
attgtcctactcaggt

SEQ ID NO: 33534 - DNA, 16 bp, Artificial Sequence
  synthetic [barcode part1]
gagagtacggattact

SEQ ID NO: 33535 - DNA, 16 bp, Artificial Sequence
  synthetic [barcode part1]
tgtagtgcgaatagac

SEQ ID NO: 33536 - DNA, 16 bp, Artificial Sequence
  synthetic [barcode part1]
agactgttacctctac

SEQ ID NO: 33537 - DNA, 16 bp, Artificial Sequence
  synthetic [barcode part1]
caaccagaccgtgatt

SEQ ID NO: 33538 - DNA, 16 bp, Artificial Sequence
  synthetic [barcode part1]
ttcgttatcctgccac

SEQ ID NO: 33539 - DNA, 16 bp, Artificial Sequence
  synthetic [barcode part1]
tcttaaccggtgagac

SEQ ID NO: 33540 - DNA, 16 bp, Artificial Sequence
  synthetic [barcode part1]
gacaggagacctgtac

SEQ ID NO: 33541 - DNA, 16 bp, Artificial Sequence
  synthetic [barcode part1]
aggcgataacctatag

SEQ ID NO: 33542 - DNA, 16 bp, Artificial Sequence
  synthetic [barcode part1]
tactaggtgagtcacc

SEQ ID NO: 33543 - DNA, 16 bp, Artificial Sequence
  synthetic [barcode part1]
atcaatacaccgacgc

SEQ ID NO: 33544 - DNA, 16 bp, Artificial Sequence
  synthetic [barcode part1]
ccaccacacagactct

SEQ ID NO: 33545 - DNA, 16 bp, Artificial Sequence
  synthetic [barcode part1]
ttcactacggtctctc

SEQ ID NO: 33546 - DNA, 16 bp, Artificial Sequence
  synthetic [barcode part1]
cagtggaacagatccg

SEQ ID NO: 33547 - DNA, 16 bp, Artificial Sequence
  synthetic [barcode part1]
tgccaatcgcaatcag

SEQ ID NO: 33548 - DNA, 16 bp, Artificial Sequence
  synthetic [barcode part1]
tagattgtgcggaagt

SEQ ID NO: 33549 - DNA, 16 bp, Artificial Sequence
  synthetic [barcode part1]
tccgaggtacgtatac

SEQ ID NO: 33550 - DNA, 16 bp, Artificial Sequence
  synthetic [barcode part1]
ttcctggactacgcac

SEQ ID NO: 33551 - DNA, 16 bp, Artificial Sequence
  synthetic [barcode part1]
tgacacgattggaagt

SEQ ID NO: 33552 - DNA, 16 bp, Artificial Sequence
  synthetic [barcode part1]
gagttcgtgaactcgt

SEQ ID NO: 33553 - DNA, 16 bp, Artificial Sequence
  synthetic [barcode part1]
tctactacgcactaac

SEQ ID NO: 33554 - DNA, 16 bp, Artificial Sequence
  synthetic [barcode part1]
tagatcgttggatcgc

SEQ ID NO: 33555 - DNA, 16 bp, Artificial Sequence
  synthetic [barcode part1]
taagagtccgtcggag

SEQ ID NO: 33556 - DNA, 16 bp, Artificial Sequence
  synthetic [barcode part1]
atcactgaagagtacg

SEQ ID NO: 33557 - DNA, 16 bp, Artificial Sequence
  synthetic [barcode part1]
tactgccttgttgtcc

SEQ ID NO: 33558 - DNA, 16 bp, Artificial Sequence
  synthetic [barcode part1]
caattggtacgacgtc

SEQ ID NO: 33559 - DNA, 16 bp, Artificial Sequence
  synthetic [barcode part1]
aggattagatcgtgtg

SEQ ID NO: 33560 - DNA, 16 bp, Artificial Sequence
  synthetic [barcode part1]
cgccttggttctatct

SEQ ID NO: 33561 - DNA, 16 bp, Artificial Sequence
  synthetic [barcode part1]
ttaggtggttcgcaac

SEQ ID NO: 33562 - DNA, 16 bp, Artificial Sequence
  synthetic [barcode part1]
tactctggcgaattct

SEQ ID NO: 33563 - DNA, 16 bp, Artificial Sequence
  synthetic [barcode part1]
acttcactctgtgagt

SEQ ID NO: 33564 - DNA, 16 bp, Artificial Sequence
  synthetic [barcode part1]
aagtaggtccgagatt

SEQ ID NO: 33565 - DNA, 16 bp, Artificial Sequence
  synthetic [barcode part1]
agacgaacaaggttct

SEQ ID NO: 33566 - DNA, 16 bp, Artificial Sequence
  synthetic [barcode part1]
tagtcctggaagacct

SEQ ID NO: 33567 - DNA, 16 bp, Artificial Sequence
  synthetic [barcode part1]
acgcgtcttaccactg

SEQ ID NO: 33568 - DNA, 16 bp, Artificial Sequence
  synthetic [barcode part1]
gacttcaagacctcag

SEQ ID NO: 33569 - DNA, 16 bp, Artificial Sequence
  synthetic [barcode part1]
ttacttgttgcgacac

SEQ ID NO: 33570 - DNA, 16 bp, Artificial Sequence
  synthetic [barcode part1]
tattctcctggatcag

SEQ ID NO: 33571 - DNA, 16 bp, Artificial Sequence
  synthetic [barcode part1]
cgagtgattacttgcg

SEQ ID NO: 33572 - DNA, 16 bp, Artificial Sequence
  synthetic [barcode part1]
ttgtaccaagtgcggt

SEQ ID NO: 33573 - DNA, 16 bp, Artificial Sequence
  synthetic [barcode part1]
tgaataggtggtactg

SEQ ID NO: 33574 - DNA, 16 bp, Artificial Sequence
  synthetic [barcode part1]
aacctccagaacaacc

SEQ ID NO: 33575 - DNA, 16 bp, Artificial Sequence
  synthetic [barcode part1]
cctgcgaatcctactg

SEQ ID NO: 33576 - DNA, 16 bp, Artificial Sequence
  synthetic [barcode part1]
ccaagagtacactaag

SEQ ID NO: 33577 - DNA, 16 bp, Artificial Sequence
  synthetic [barcode part1]
gacaggatctctaacc

SEQ ID NO: 33578 - DNA, 16 bp, Artificial Sequence
  synthetic [barcode part1]
tgaaggaaccgcgtgt

SEQ ID NO: 33579 - DNA, 16 bp, Artificial Sequence
  synthetic [barcode part1]
aacaacctcttgcgcc

SEQ ID NO: 33580 - DNA, 16 bp, Artificial Sequence
  synthetic [barcode part1]
gaccagttcgattggt

SEQ ID NO: 33581 - DNA, 16 bp, Artificial Sequence
  synthetic [barcode part1]
cctacctcaggatctg

SEQ ID NO: 33582 - DNA, 16 bp, Artificial Sequence
  synthetic [barcode part1]
aactgcagttgacgtc

SEQ ID NO: 33583 - DNA, 16 bp, Artificial Sequence
  synthetic [barcode part1]
gtcacctctcactatc

SEQ ID NO: 33584 - DNA, 16 bp, Artificial Sequence
  synthetic [barcode part1]
tgtcagataggaacac

SEQ ID NO: 33585 - DNA, 16 bp, Artificial Sequence
  synthetic [barcode part1]
tgacgagatccacgag

SEQ ID NO: 33586 - DNA, 16 bp, Artificial Sequence
  synthetic [barcode part1]
gtatcagtcgaacacc

SEQ ID NO: 33587 - DNA, 16 bp, Artificial Sequence
  synthetic [barcode part1]
aatccgttcgcctcag

SEQ ID NO: 33588 - DNA, 16 bp, Artificial Sequence
  synthetic [barcode part1]
cctagtctatagttgc

SEQ ID NO: 33589 - DNA, 16 bp, Artificial Sequence
  synthetic [barcode part1]
gagatcttctacctac

SEQ ID NO: 33590 - DNA, 16 bp, Artificial Sequence
  synthetic [barcode part1]
agtgcactgcgcaatt

SEQ ID NO: 33591 - DNA, 16 bp, Artificial Sequence
  synthetic [barcode part1]
gtgattccaccaagtg

SEQ ID NO: 33592 - DNA, 16 bp, Artificial Sequence
  synthetic [barcode part1]
gtactggaggacaatt

SEQ ID NO: 33593 - DNA, 16 bp, Artificial Sequence
  synthetic [barcode part1]
gtatattcggaaggtg

SEQ ID NO: 33594 - DNA, 16 bp, Artificial Sequence
  synthetic [barcode part1]
gccgtgttcagtatag

SEQ ID NO: 33595 - DNA, 16 bp, Artificial Sequence
  synthetic [barcode part1]
tctcgcacaatctggc

SEQ ID NO: 33596 - DNA, 16 bp, Artificial Sequence
  synthetic [barcode part1]
tgtcgccacctagact

SEQ ID NO: 33597 - DNA, 16 bp, Artificial Sequence
  synthetic [barcode part1]
acgtcaaccaggtatc

SEQ ID NO: 33598 - DNA, 16 bp, Artificial Sequence
  synthetic [barcode part1]
cactactgtgatcgtt

SEQ ID NO: 33599 - DNA, 16 bp, Artificial Sequence
  synthetic [barcode part1]
acacgtaccggttaac

SEQ ID NO: 33600 - DNA, 16 bp, Artificial Sequence
  synthetic [barcode part1]
cctagattctggcctg

SEQ ID NO: 33601 - DNA, 16 bp, Artificial Sequence
  synthetic [barcode part1]
ttggactaaccgtcag

SEQ ID NO: 33602 - DNA, 16 bp, Artificial Sequence
  synthetic [barcode part1]
aaggatagtctctgcc

SEQ ID NO: 33603 - DNA, 16 bp, Artificial Sequence
  synthetic [barcode part1]
ttaacctacaaccgtc

SEQ ID NO: 33604 - DNA, 16 bp, Artificial Sequence
  synthetic [barcode part1]
attaacacactccacc

SEQ ID NO: 33605 - DNA, 16 bp, Artificial Sequence
  synthetic [barcode part1]
ttcgcacttaggccac

SEQ ID NO: 33606 - DNA, 16 bp, Artificial Sequence
  synthetic [barcode part1]
tgtgtcacgatcgtag

SEQ ID NO: 33607 - DNA, 16 bp, Artificial Sequence
  synthetic [barcode part1]
tggacacagtctacgt

SEQ ID NO: 33608 - DNA, 16 bp, Artificial Sequence
  synthetic [barcode part1]
cggtgatcgcactctt

SEQ ID NO: 33609 - DNA, 16 bp, Artificial Sequence
  synthetic [barcode part1]
tacaccaggttagaag

SEQ ID NO: 33610 - DNA, 16 bp, Artificial Sequence
  synthetic [barcode part1]
tagtggcgattcggtt

SEQ ID NO: 33611 - DNA, 16 bp, Artificial Sequence
  synthetic [barcode part1]
cgaggagatattggtt

SEQ ID NO: 33612 - DNA, 16 bp, Artificial Sequence
  synthetic [barcode part1]
gcacaaggtgacctag

SEQ ID NO: 33613 - DNA, 16 bp, Artificial Sequence
  synthetic [barcode part1]
ttggaacttactcacc

SEQ ID NO: 33614 - DNA, 16 bp, Artificial Sequence
  synthetic [barcode part1]
tgacgtaacacggttc

SEQ ID NO: 33615 - DNA, 16 bp, Artificial Sequence
  synthetic [barcode part1]
tatctactctgtccgc

SEQ ID NO: 33616 - DNA, 16 bp, Artificial Sequence
  synthetic [barcode part1]
cgaactggacttggtt

SEQ ID NO: 33617 - DNA, 16 bp, Artificial Sequence
  synthetic [barcode part1]
tatactacgtggccag

SEQ ID NO: 33618 - DNA, 16 bp, Artificial Sequence
  synthetic [barcode part1]
gacgcgttcctagttc

SEQ ID NO: 33619 - DNA, 16 bp, Artificial Sequence
  synthetic [barcode part1]
gcgtctcactagacct

SEQ ID NO: 33620 - DNA, 16 bp, Artificial Sequence
  synthetic [barcode part1]
atccgttcgcctactt

SEQ ID NO: 33621 - DNA, 16 bp, Artificial Sequence
  synthetic [barcode part1]
atagtcgcacgtgatc

SEQ ID NO: 33622 - DNA, 16 bp, Artificial Sequence
  synthetic [barcode part1]
gcactgattctcaact

SEQ ID NO: 33623 - DNA, 16 bp, Artificial Sequence
  synthetic [barcode part1]
agttggtcacaacgtc

SEQ ID NO: 33624 - DNA, 16 bp, Artificial Sequence
  synthetic [barcode part1]
taattcacgtcaggcg

SEQ ID NO: 33625 - DNA, 16 bp, Artificial Sequence
  synthetic [barcode part1]
ttggagtctcggaatc

SEQ ID NO: 33626 - DNA, 16 bp, Artificial Sequence
  synthetic [barcode part1]
cgttgttaggtcaggt

SEQ ID NO: 33627 - DNA, 16 bp, Artificial Sequence
  synthetic [barcode part1]
tgtgttgcaaccacag

SEQ ID NO: 33628 - DNA, 16 bp, Artificial Sequence
  synthetic [barcode part1]
taggcagatagtgccg

SEQ ID NO: 33629 - DNA, 16 bp, Artificial Sequence
  synthetic [barcode part1]
ccgtacttactggacc

SEQ ID NO: 33630 - DNA, 16 bp, Artificial Sequence
  synthetic [barcode part1]
aagtaggtgttacggt

SEQ ID NO: 33631 - DNA, 16 bp, Artificial Sequence
  synthetic [barcode part1]
tatcttgtgtctaggc

SEQ ID NO: 33632 - DNA, 16 bp, Artificial Sequence
  synthetic [barcode part1]
ttggttgacgttgcag

SEQ ID NO: 33633 - DNA, 16 bp, Artificial Sequence
  synthetic [barcode part1]
gttgttgactgagtcg

SEQ ID NO: 33634 - DNA, 16 bp, Artificial Sequence
  synthetic [barcode part1]
ataacttccgtatccg

SEQ ID NO: 33635 - DNA, 16 bp, Artificial Sequence
  synthetic [barcode part1]
gtctcactattgacac

SEQ ID NO: 33636 - DNA, 16 bp, Artificial Sequence
  synthetic [barcode part1]
cgatcggttgatcaac

SEQ ID NO: 33637 - DNA, 16 bp, Artificial Sequence
  synthetic [barcode part1]
tgccaagttgtatcct

SEQ ID NO: 33638 - DNA, 16 bp, Artificial Sequence
  synthetic [barcode part1]
cgagtaccacagactt

SEQ ID NO: 33639 - DNA, 16 bp, Artificial Sequence
  synthetic [barcode part1]
agacgttagtagaacc

SEQ ID NO: 33640 - DNA, 16 bp, Artificial Sequence
  synthetic [barcode part1]
aggcctagtggttact

SEQ ID NO: 33641 - DNA, 16 bp, Artificial Sequence
  synthetic [barcode part1]
aactgtgagtcaagac

SEQ ID NO: 33642 - DNA, 16 bp, Artificial Sequence
  synthetic [barcode part1]
ccgttaagacttgacg

SEQ ID NO: 33643 - DNA, 16 bp, Artificial Sequence
  synthetic [barcode part1]
atacgacggaactaac

SEQ ID NO: 33644 - DNA, 16 bp, Artificial Sequence
  synthetic [barcode part1]
ccggttctattaacgt

SEQ ID NO: 33645 - DNA, 16 bp, Artificial Sequence
  synthetic [barcode part1]
acggatcaagacgatt

SEQ ID NO: 33646 - DNA, 16 bp, Artificial Sequence
  synthetic [barcode part1]
cggcagtgtgtaagac

SEQ ID NO: 33647 - DNA, 16 bp, Artificial Sequence
  synthetic [barcode part1]
cggcagttataagaac

SEQ ID NO: 33648 - DNA, 16 bp, Artificial Sequence
  synthetic [barcode part1]
gtgactggttgtgtgt

SEQ ID NO: 33649 - DNA, 16 bp, Artificial Sequence
  synthetic [barcode part1]
tgatcgactgatcgac

SEQ ID NO: 33650 - DNA, 16 bp, Artificial Sequence
  synthetic [barcode part1]
ttgaagatcttcggcg

SEQ ID NO: 33651 - DNA, 16 bp, Artificial Sequence
  synthetic [barcode part1]
actaggtagacgcgac

SEQ ID NO: 33652 - DNA, 16 bp, Artificial Sequence
  synthetic [barcode part1]
gtaggtcaccgttcct

SEQ ID NO: 33653 - DNA, 16 bp, Artificial Sequence
  synthetic [barcode part1]
tcctacgtcgacaacc

SEQ ID NO: 33654 - DNA, 16 bp, Artificial Sequence
  synthetic [barcode part1]
gttgaggttggaagag

SEQ ID NO: 33655 - DNA, 16 bp, Artificial Sequence
  synthetic [barcode part1]
gttgaactgttcctac

SEQ ID NO: 33656 - DNA, 16 bp, Artificial Sequence
  synthetic [barcode part1]
agtaccgtcaactggt

SEQ ID NO: 33657 - DNA, 16 bp, Artificial Sequence
  synthetic [barcode part1]
ccaagacttcacttgt

SEQ ID NO: 33658 - DNA, 16 bp, Artificial Sequence
  synthetic [barcode part1]
agaattgtcctcgacg

SEQ ID NO: 33659 - DNA, 16 bp, Artificial Sequence
  synthetic [barcode part1]
cagaggaagttaggac

SEQ ID NO: 33660 - DNA, 16 bp, Artificial Sequence
  synthetic [barcode part1]
cacgtcttagaccgtc

SEQ ID NO: 33661 - DNA, 16 bp, Artificial Sequence
  synthetic [barcode part1]
gtcaacggagtgttct

SEQ ID NO: 33662 - DNA, 16 bp, Artificial Sequence
  synthetic [barcode part1]
cgacaaccgtaggagt

SEQ ID NO: 33663 - DNA, 16 bp, Artificial Sequence
  synthetic [barcode part1]
aaccttcgtgcaactt

SEQ ID NO: 33664 - DNA, 16 bp, Artificial Sequence
  synthetic [barcode part1]
cgttagtaatcttccg

SEQ ID NO: 33665 - DNA, 16 bp, Artificial Sequence
  synthetic [barcode part1]
agaacgagtgaatcct

SEQ ID NO: 33666 - DNA, 16 bp, Artificial Sequence
  synthetic [barcode part1]
gtagtggtaccaatag

SEQ ID NO: 33667 - DNA, 16 bp, Artificial Sequence
  synthetic [barcode part1]
cctacggtaaggtgag

SEQ ID NO: 33668 - DNA, 16 bp, Artificial Sequence
  synthetic [barcode part1]
tccgtatcacgtcctt

SEQ ID NO: 33669 - DNA, 16 bp, Artificial Sequence
  synthetic [barcode part1]
gacgatctggttcagt

SEQ ID NO: 33670 - DNA, 16 bp, Artificial Sequence
  synthetic [barcode part1]
tcgaacgacgaacctt

SEQ ID NO: 33671 - DNA, 16 bp, Artificial Sequence
  synthetic [barcode part1]
taagactgcgcacgtt

SEQ ID NO: 33672 - DNA, 16 bp, Artificial Sequence
  synthetic [barcode part1]
aatcacaggttctcct

SEQ ID NO: 33673 - DNA, 16 bp, Artificial Sequence
  synthetic [barcode part1]
gagatattcgacaacg

SEQ ID NO: 33674 - DNA, 16 bp, Artificial Sequence
  synthetic [barcode part1]
cgtcgagtgaattgtc

SEQ ID NO: 33675 - DNA, 16 bp, Artificial Sequence
  synthetic [barcode part1]
acacgacaggaggtct

SEQ ID NO: 33676 - DNA, 16 bp, Artificial Sequence
  synthetic [barcode part1]
attgtgcactacttcg

SEQ ID NO: 33677 - DNA, 16 bp, Artificial Sequence
  synthetic [barcode part1]
taccgtcgtagtcgtc

SEQ ID NO: 33678 - DNA, 16 bp, Artificial Sequence
  synthetic [barcode part1]
agtgtatcttcggtct

SEQ ID NO: 33679 - DNA, 16 bp, Artificial Sequence
  synthetic [barcode part1]
cctaactcacgtagtt

SEQ ID NO: 33680 - DNA, 16 bp, Artificial Sequence
  synthetic [barcode part1]
tcaaggtggataggcc

SEQ ID NO: 33681 - DNA, 16 bp, Artificial Sequence
  synthetic [barcode part1]
ccttgcacagtctgac

SEQ ID NO: 33682 - DNA, 16 bp, Artificial Sequence
  synthetic [barcode part1]
ccaggtggatacttac

SEQ ID NO: 33683 - DNA, 16 bp, Artificial Sequence
  synthetic [barcode part1]
aggacactgacaaccg

SEQ ID NO: 33684 - DNA, 16 bp, Artificial Sequence
  synthetic [barcode part1]
cggtagtcaattcggt

SEQ ID NO: 33685 - DNA, 16 bp, Artificial Sequence
  synthetic [barcode part1]
atcctacaccttccgt

SEQ ID NO: 33686 - DNA, 16 bp, Artificial Sequence
  synthetic [barcode part1]
tgactgtcttgcgaag

SEQ ID NO: 33687 - DNA, 16 bp, Artificial Sequence
  synthetic [barcode part1]
actccactctagtctc

SEQ ID NO: 33688 - DNA, 16 bp, Artificial Sequence
  synthetic [barcode part1]
cgacgtcttacctacg

SEQ ID NO: 33689 - DNA, 16 bp, Artificial Sequence
  synthetic [barcode part1]
gttcgaggtcttatct

SEQ ID NO: 33690 - DNA, 16 bp, Artificial Sequence
  synthetic [barcode part1]
gacgattatacaaggc

SEQ ID NO: 33691 - DNA, 16 bp, Artificial Sequence
  synthetic [barcode part1]
tgtgtcttgtcggatt

SEQ ID NO: 33692 - DNA, 16 bp, Artificial Sequence
  synthetic [barcode part1]
aaggcggatctatagt

SEQ ID NO: 33693 - DNA, 16 bp, Artificial Sequence
  synthetic [barcode part1]
ttcgagtaacgcactg

SEQ ID NO: 33694 - DNA, 16 bp, Artificial Sequence
  synthetic [barcode part1]
acgagagttagattgc

SEQ ID NO: 33695 - DNA, 16 bp, Artificial Sequence
  synthetic [barcode part1]
gatcactgacgtggag

SEQ ID NO: 33696 - DNA, 16 bp, Artificial Sequence
  synthetic [barcode part1]
tgcgcaacgaacttgt

SEQ ID NO: 33697 - DNA, 16 bp, Artificial Sequence
  synthetic [barcode part1]
agactcgtgttctgtt

SEQ ID NO: 33698 - DNA, 16 bp, Artificial Sequence
  synthetic [barcode part1]
acctaaggtggattcc

SEQ ID NO: 33699 - DNA, 16 bp, Artificial Sequence
  synthetic [barcode part1]
tgcgcaagaaccaggt

SEQ ID NO: 33700 - DNA, 16 bp, Artificial Sequence
  synthetic [barcode part1]
gtcaactcttcctctg

SEQ ID NO: 33701 - DNA, 16 bp, Artificial Sequence
  synthetic [barcode part1]
tcctaagactcgcctg

SEQ ID NO: 33702 - DNA, 16 bp, Artificial Sequence
  synthetic [barcode part1]
cggtacagagaattgt

SEQ ID NO: 33703 - DNA, 16 bp, Artificial Sequence
  synthetic [barcode part1]
agtgacttcagtgacc

SEQ ID NO: 33704 - DNA, 16 bp, Artificial Sequence
  synthetic [barcode part1]
gcgaattaagagttgc

SEQ ID NO: 33705 - DNA, 16 bp, Artificial Sequence
  synthetic [barcode part1]
aggcggaagattccgt

SEQ ID NO: 33706 - DNA, 16 bp, Artificial Sequence
  synthetic [barcode part1]
cacgacgtcgtaatac

SEQ ID NO: 33707 - DNA, 16 bp, Artificial Sequence
  synthetic [barcode part1]
attgtcggcgtgagag

SEQ ID NO: 33708 - DNA, 16 bp, Artificial Sequence
  synthetic [barcode part1]
gtcacttgcggtaagt

SEQ ID NO: 33709 - DNA, 16 bp, Artificial Sequence
  synthetic [barcode part1]
tacctgcgacagatac

SEQ ID NO: 33710 - DNA, 16 bp, Artificial Sequence
  synthetic [barcode part1]
aatagaggacctacac

SEQ ID NO: 33711 - DNA, 16 bp, Artificial Sequence
  synthetic [barcode part1]
tctgtacggaggtgtt

SEQ ID NO: 33712 - DNA, 16 bp, Artificial Sequence
  synthetic [barcode part1]
tatccacggtatcact

SEQ ID NO: 33713 - DNA, 16 bp, Artificial Sequence
  synthetic [barcode part1]
caggagtcgaatcgtg

SEQ ID NO: 33714 - DNA, 16 bp, Artificial Sequence
  synthetic [barcode part1]
ttatcgtggacctatc

SEQ ID NO: 33715 - DNA, 16 bp, Artificial Sequence
  synthetic [barcode part1]
tcaatctgcaaccgcc

SEQ ID NO: 33716 - DNA, 16 bp, Artificial Sequence
  synthetic [barcode part1]
caagtggatagtgttg

SEQ ID NO: 33717 - DNA, 16 bp, Artificial Sequence
  synthetic [barcode part1]
aataacgtgccgttcg

SEQ ID NO: 33718 - DNA, 16 bp, Artificial Sequence
  synthetic [barcode part1]
gattggtctgactgac

SEQ ID NO: 33719 - DNA, 16 bp, Artificial Sequence
  synthetic [barcode part1]
cgacggtattgaatcc

SEQ ID NO: 33720 - DNA, 16 bp, Artificial Sequence
  synthetic [barcode part1]
tctagttccgatcctc

SEQ ID NO: 33721 - DNA, 16 bp, Artificial Sequence
  synthetic [barcode part1]
aatccaacctcacact

SEQ ID NO: 33722 - DNA, 16 bp, Artificial Sequence
  synthetic [barcode part1]
tcgttgacgtgttccg

SEQ ID NO: 33723 - DNA, 16 bp, Artificial Sequence
  synthetic [barcode part1]
gccttatctcagtcct

SEQ ID NO: 33724 - DNA, 16 bp, Artificial Sequence
  synthetic [barcode part1]
aagaccttgtcgtgac

SEQ ID NO: 33725 - DNA, 16 bp, Artificial Sequence
  synthetic [barcode part1]
ttggatacggagtagt

SEQ ID NO: 33726 - DNA, 16 bp, Artificial Sequence
  synthetic [barcode part1]
gtatctctcctcgtgt

SEQ ID NO: 33727 - DNA, 16 bp, Artificial Sequence
  synthetic [barcode part1]
cgtgtgactatcgcct

SEQ ID NO: 33728 - DNA, 16 bp, Artificial Sequence
  synthetic [barcode part1]
acgtcaatagttctcc

SEQ ID NO: 33729 - DNA, 16 bp, Artificial Sequence
  synthetic [barcode part1]
cgaagagtaacacgcc

SEQ ID NO: 33730 - DNA, 16 bp, Artificial Sequence
  synthetic [barcode part1]
cagtcgagatcgactt

SEQ ID NO: 33731 - DNA, 16 bp, Artificial Sequence
  synthetic [barcode part1]
cgactaacacggtatc

SEQ ID NO: 33732 - DNA, 16 bp, Artificial Sequence
  synthetic [barcode part1]
cagaggtcctgacaag

SEQ ID NO: 33733 - DNA, 16 bp, Artificial Sequence
  synthetic [barcode part1]
ccactggaatcactag

SEQ ID NO: 33734 - DNA, 16 bp, Artificial Sequence
  synthetic [barcode part1]
tcaaggtacaggtggc

SEQ ID NO: 33735 - DNA, 16 bp, Artificial Sequence
  synthetic [barcode part1]
gttcgtatcagacacg

SEQ ID NO: 33736 - DNA, 16 bp, Artificial Sequence
  synthetic [barcode part1]
tgccttcgattactag

SEQ ID NO: 33737 - DNA, 16 bp, Artificial Sequence
  synthetic [barcode part1]
tatagactccgtcgtt

SEQ ID NO: 33738 - DNA, 16 bp, Artificial Sequence
  synthetic [barcode part1]
cgtcttcagagatacg

SEQ ID NO: 33739 - DNA, 16 bp, Artificial Sequence
  synthetic [barcode part1]
acactgacctcactgc

SEQ ID NO: 33740 - DNA, 16 bp, Artificial Sequence
  synthetic [barcode part1]
atagactcagtgaggt

SEQ ID NO: 33741 - DNA, 16 bp, Artificial Sequence
  synthetic [barcode part1]
gttataggcagtgcct

SEQ ID NO: 33742 - DNA, 16 bp, Artificial Sequence
  synthetic [barcode part1]
cgattctacgttggtt

SEQ ID NO: 33743 - DNA, 16 bp, Artificial Sequence
  synthetic [barcode part1]
cggtgtgtaatcctcc

SEQ ID NO: 33744 - DNA, 16 bp, Artificial Sequence
  synthetic [barcode part1]
tacctcgtactgttcc

SEQ ID NO: 33745 - DNA, 16 bp, Artificial Sequence
  synthetic [barcode part1]
acgtccttagtggtcc

SEQ ID NO: 33746 - DNA, 16 bp, Artificial Sequence
  synthetic [barcode part1]
acagactgaggattac

SEQ ID NO: 33747 - DNA, 16 bp, Artificial Sequence
  synthetic [barcode part1]
cctatcagtgcaatct

SEQ ID NO: 33748 - DNA, 16 bp, Artificial Sequence
  synthetic [barcode part1]
aactgtgtgcacaacc

SEQ ID NO: 33749 - DNA, 16 bp, Artificial Sequence
  synthetic [barcode part1]
ccttacgaccagatcc

SEQ ID NO: 33750 - DNA, 16 bp, Artificial Sequence
  synthetic [barcode part1]
cagagtgagtgacaag

SEQ ID NO: 33751 - DNA, 16 bp, Artificial Sequence
  synthetic [barcode part1]
ccgtctaagtgtcgtc

SEQ ID NO: 33752 - DNA, 16 bp, Artificial Sequence
  synthetic [barcode part1]
taaccttccgatcctc

SEQ ID NO: 33753 - DNA, 16 bp, Artificial Sequence
  synthetic [barcode part1]
accaatacagaggact

SEQ ID NO: 33754 - DNA, 16 bp, Artificial Sequence
  synthetic [barcode part1]
agacaatccttgccag

SEQ ID NO: 33755 - DNA, 16 bp, Artificial Sequence
  synthetic [barcode part1]
aactgtgtgacacgtc

SEQ ID NO: 33756 - DNA, 16 bp, Artificial Sequence
  synthetic [barcode part1]
aagaccgccagtacag

SEQ ID NO: 33757 - DNA, 16 bp, Artificial Sequence
  synthetic [barcode part1]
tcacggcactgattag

SEQ ID NO: 33758 - DNA, 16 bp, Artificial Sequence
  synthetic [barcode part1]
cagatctcttattgcg

SEQ ID NO: 33759 - DNA, 16 bp, Artificial Sequence
  synthetic [barcode part1]
cagaacgttgtcgttg

SEQ ID NO: 33760 - DNA, 16 bp, Artificial Sequence
  synthetic [barcode part1]
tcaggttggagtatag

SEQ ID NO: 33761 - DNA, 16 bp, Artificial Sequence
  synthetic [barcode part1]
tactatcttgtgcgac

SEQ ID NO: 33762 - DNA, 16 bp, Artificial Sequence
  synthetic [barcode part1]
gtctcacgtcttctac

SEQ ID NO: 33763 - DNA, 16 bp, Artificial Sequence
  synthetic [barcode part1]
attagtagttctccgc

SEQ ID NO: 33764 - DNA, 16 bp, Artificial Sequence
  synthetic [barcode part1]
aatcacgagttctctc

SEQ ID NO: 33765 - DNA, 16 bp, Artificial Sequence
  synthetic [barcode part1]
gccagaattcttcgag

SEQ ID NO: 33766 - DNA, 16 bp, Artificial Sequence
  synthetic [barcode part1]
atactctcggtaatcc

SEQ ID NO: 33767 - DNA, 16 bp, Artificial Sequence
  synthetic [barcode part1]
tcgaacggaactcgtt

SEQ ID NO: 33768 - DNA, 16 bp, Artificial Sequence
  synthetic [barcode part1]
tgtgacggaataggtt

SEQ ID NO: 33769 - DNA, 16 bp, Artificial Sequence
  synthetic [barcode part1]
tcgaaggtagtctctg

SEQ ID NO: 33770 - DNA, 16 bp, Artificial Sequence
  synthetic [barcode part1]
ttaatacgtgccggtg

SEQ ID NO: 33771 - DNA, 16 bp, Artificial Sequence
  synthetic [barcode part1]
tccttccggaactctt

SEQ ID NO: 33772 - DNA, 16 bp, Artificial Sequence
  synthetic [barcode part1]
gtgtccttgtaggaac

SEQ ID NO: 33773 - DNA, 16 bp, Artificial Sequence
  synthetic [barcode part1]
ttcagtggagtcgttg

SEQ ID NO: 33774 - DNA, 16 bp, Artificial Sequence
  synthetic [barcode part1]
aattcgcagtgaagtg

SEQ ID NO: 33775 - DNA, 16 bp, Artificial Sequence
  synthetic [barcode part1]
gatctagagaacgcgc

SEQ ID NO: 33776 - DNA, 16 bp, Artificial Sequence
  synthetic [barcode part1]
gtcggtaaggtactct

SEQ ID NO: 33777 - DNA, 16 bp, Artificial Sequence
  synthetic [barcode part1]
ttcagtggtgatccag

SEQ ID NO: 33778 - DNA, 16 bp, Artificial Sequence
  synthetic [barcode part1]
tcactgtcgagtactt

SEQ ID NO: 33779 - DNA, 16 bp, Artificial Sequence
  synthetic [barcode part1]
tccgtaatccagacag

SEQ ID NO: 33780 - DNA, 16 bp, Artificial Sequence
  synthetic [barcode part1]
gttgaactatccttgc

SEQ ID NO: 33781 - DNA, 16 bp, Artificial Sequence
  synthetic [barcode part1]
cgatagttcctgcgtc

SEQ ID NO: 33782 - DNA, 16 bp, Artificial Sequence
  synthetic [barcode part1]
accacgaacgaatagt

SEQ ID NO: 33783 - DNA, 16 bp, Artificial Sequence
  synthetic [barcode part1]
tggtgatccttgtatc

SEQ ID NO: 33784 - DNA, 16 bp, Artificial Sequence
  synthetic [barcode part1]
tacctccgacttggtg

SEQ ID NO: 33785 - DNA, 16 bp, Artificial Sequence
  synthetic [barcode part1]
caccgtcgaactaagt

SEQ ID NO: 33786 - DNA, 16 bp, Artificial Sequence
  synthetic [barcode part1]
gattcgtgtctgcaag

SEQ ID NO: 33787 - DNA, 16 bp, Artificial Sequence
  synthetic [barcode part1]
agacgtggccactaag

SEQ ID NO: 33788 - DNA, 16 bp, Artificial Sequence
  synthetic [barcode part1]
aacttccgccactctt

SEQ ID NO: 33789 - DNA, 16 bp, Artificial Sequence
  synthetic [barcode part1]
tcttcctaacttcggc

SEQ ID NO: 33790 - DNA, 16 bp, Artificial Sequence
  synthetic [barcode part1]
ttgttgcctgtctcgt

SEQ ID NO: 33791 - DNA, 16 bp, Artificial Sequence
  synthetic [barcode part1]
agtcgttacctccgtg

SEQ ID NO: 33792 - DNA, 16 bp, Artificial Sequence
  synthetic [barcode part1]
ttccaacgtgtctagt

SEQ ID NO: 33793 - DNA, 16 bp, Artificial Sequence
  synthetic [barcode part1]
agtgatctcttacgtc

SEQ ID NO: 33794 - DNA, 16 bp, Artificial Sequence
  synthetic [barcode part1]
atacggttctctcaac

SEQ ID NO: 33795 - DNA, 16 bp, Artificial Sequence
  synthetic [barcode part1]
gaatcaaggaaggtcg

SEQ ID NO: 33796 - DNA, 16 bp, Artificial Sequence
  synthetic [barcode part1]
cgttctggtctgtgac

SEQ ID NO: 33797 - DNA, 16 bp, Artificial Sequence
  synthetic [barcode part1]
cctgtaagtaacgaag

SEQ ID NO: 33798 - DNA, 16 bp, Artificial Sequence
  synthetic [barcode part1]
aacgttgtggtcaacc

SEQ ID NO: 33799 - DNA, 16 bp, Artificial Sequence
  synthetic [barcode part1]
acgccgttggatagag

SEQ ID NO: 33800 - DNA, 16 bp, Artificial Sequence
  synthetic [barcode part1]
tcggcagagattactc

SEQ ID NO: 33801 - DNA, 16 bp, Artificial Sequence
  synthetic [barcode part1]
cgtgaagaatctaacg

SEQ ID NO: 33802 - DNA, 16 bp, Artificial Sequence
  synthetic [barcode part1]
tcctcctccagaatct

SEQ ID NO: 33803 - DNA, 16 bp, Artificial Sequence
  synthetic [barcode part1]
ttccgcgaattcgatt

SEQ ID NO: 33804 - DNA, 16 bp, Artificial Sequence
  synthetic [barcode part1]
tctcaccttactccag

SEQ ID NO: 33805 - DNA, 16 bp, Artificial Sequence
  synthetic [barcode part1]
ttgtatctccgcactc

SEQ ID NO: 33806 - DNA, 16 bp, Artificial Sequence
  synthetic [barcode part1]
tagtattgcgagtgag

SEQ ID NO: 33807 - DNA, 16 bp, Artificial Sequence
  synthetic [barcode part1]
gcacaacaattcctct

SEQ ID NO: 33808 - DNA, 16 bp, Artificial Sequence
  synthetic [barcode part1]
tgccagatcgcgtctt

SEQ ID NO: 33809 - DNA, 16 bp, Artificial Sequence
  synthetic [barcode part1]
ttcaaccgtgtcaact

SEQ ID NO: 33810 - DNA, 16 bp, Artificial Sequence
  synthetic [barcode part1]
aggaataagtggtctc

SEQ ID NO: 33811 - DNA, 16 bp, Artificial Sequence
  synthetic [barcode part1]
ccgcggaagatatctt

SEQ ID NO: 33812 - DNA, 16 bp, Artificial Sequence
  synthetic [barcode part1]
gtcgcaggtaagtgac

SEQ ID NO: 33813 - DNA, 16 bp, Artificial Sequence
  synthetic [barcode part1]
ccgttacggtatctgc

SEQ ID NO: 33814 - DNA, 16 bp, Artificial Sequence
  synthetic [barcode part1]
agagacggacgattcc

SEQ ID NO: 33815 - DNA, 16 bp, Artificial Sequence
  synthetic [barcode part1]
gaacgaatactgtggt

SEQ ID NO: 33816 - DNA, 16 bp, Artificial Sequence
  synthetic [barcode part1]
acgactggatcttctt

SEQ ID NO: 33817 - DNA, 16 bp, Artificial Sequence
  synthetic [barcode part1]
acagacgtacctgttg

SEQ ID NO: 33818 - DNA, 16 bp, Artificial Sequence
  synthetic [barcode part1]
cgtaactgacctacag

SEQ ID NO: 33819 - DNA, 16 bp, Artificial Sequence
  synthetic [barcode part1]
tagtcggactaaccgt

SEQ ID NO: 33820 - DNA, 16 bp, Artificial Sequence
  synthetic [barcode part1]
ccgagtgataagtctc

SEQ ID NO: 33821 - DNA, 16 bp, Artificial Sequence
  synthetic [barcode part1]
aacaagtggtgccgtg

SEQ ID NO: 33822 - DNA, 16 bp, Artificial Sequence
  synthetic [barcode part1]
cacaccttctggtgac

SEQ ID NO: 33823 - DNA, 16 bp, Artificial Sequence
  synthetic [barcode part1]
cgattctccaaggagt

SEQ ID NO: 33824 - DNA, 16 bp, Artificial Sequence
  synthetic [barcode part1]
cgttatcgtgactact

SEQ ID NO: 33825 - DNA, 16 bp, Artificial Sequence
  synthetic [barcode part1]
aagtgttgcggcaggt

SEQ ID NO: 33826 - DNA, 16 bp, Artificial Sequence
  synthetic [barcode part1]
cctacctgatattacg

SEQ ID NO: 33827 - DNA, 16 bp, Artificial Sequence
  synthetic [barcode part1]
taggcgttcctcgact

SEQ ID NO: 33828 - DNA, 16 bp, Artificial Sequence
  synthetic [barcode part1]
gaaggattcgcgcagt

SEQ ID NO: 33829 - DNA, 16 bp, Artificial Sequence
  synthetic [barcode part1]
cgaatcagtcggattc

SEQ ID NO: 33830 - DNA, 16 bp, Artificial Sequence
  synthetic [barcode part1]
tatatacgtcggccag

SEQ ID NO: 33831 - DNA, 16 bp, Artificial Sequence
  synthetic [barcode part1]
gtggtccggattattg

SEQ ID NO: 33832 - DNA, 16 bp, Artificial Sequence
  synthetic [barcode part1]
ccttagaagtatcgcg

SEQ ID NO: 33833 - DNA, 16 bp, Artificial Sequence
  synthetic [barcode part1]
tggtacactcttgatc

SEQ ID NO: 33834 - DNA, 16 bp, Artificial Sequence
  synthetic [barcode part1]
taatagtctctgtgcc

SEQ ID NO: 33835 - DNA, 16 bp, Artificial Sequence
  synthetic [barcode part1]
gtacggatctgacgag

SEQ ID NO: 33836 - DNA, 16 bp, Artificial Sequence
  synthetic [barcode part1]
gtgaactaaggcaatc

SEQ ID NO: 33837 - DNA, 16 bp, Artificial Sequence
  synthetic [barcode part1]
tggcaatcgcaggaac

SEQ ID NO: 33838 - DNA, 16 bp, Artificial Sequence
  synthetic [barcode part1]
tgatcgtctgtcgtcg

SEQ ID NO: 33839 - DNA, 16 bp, Artificial Sequence
  synthetic [barcode part1]
tacgttggttgtgcag

SEQ ID NO: 33840 - DNA, 16 bp, Artificial Sequence
  synthetic [barcode part1]
accttcagacagttct

SEQ ID NO: 33841 - DNA, 16 bp, Artificial Sequence
  synthetic [barcode part1]
acgccgatctccaatc

SEQ ID NO: 33842 - DNA, 16 bp, Artificial Sequence
  synthetic [barcode part1]
gaaggacacctcttac

SEQ ID NO: 33843 - DNA, 16 bp, Artificial Sequence
  synthetic [barcode part1]
tgcctatagacggact

SEQ ID NO: 33844 - DNA, 16 bp, Artificial Sequence
  synthetic [barcode part1]
gacgtcagttgcaact

SEQ ID NO: 33845 - DNA, 16 bp, Artificial Sequence
  synthetic [barcode part1]
gtgcgcgcaactaatt

SEQ ID NO: 33846 - DNA, 16 bp, Artificial Sequence
  synthetic [barcode part1]
tgcagaggttatcaag

SEQ ID NO: 33847 - DNA, 16 bp, Artificial Sequence
  synthetic [barcode part1]
atactccggagacgtt

SEQ ID NO: 33848 - DNA, 16 bp, Artificial Sequence
  synthetic [barcode part1]
gcagtactgactgact

SEQ ID NO: 33849 - DNA, 16 bp, Artificial Sequence
  synthetic [barcode part1]
acgtaactagtcacgc

SEQ ID NO: 33850 - DNA, 16 bp, Artificial Sequence
  synthetic [barcode part1]
gtccgtgaggatagtg

SEQ ID NO: 33851 - DNA, 16 bp, Artificial Sequence
  synthetic [barcode part1]
ttcggataggtgtctg

SEQ ID NO: 33852 - DNA, 16 bp, Artificial Sequence
  synthetic [barcode part1]
aataataggcgcctag

SEQ ID NO: 33853 - DNA, 16 bp, Artificial Sequence
  synthetic [barcode part1]
attaccgcacgtcctg

SEQ ID NO: 33854 - DNA, 16 bp, Artificial Sequence
  synthetic [barcode part1]
agaatctccgtctgtt

SEQ ID NO: 33855 - DNA, 16 bp, Artificial Sequence
  synthetic [barcode part1]
gtcgtgaccactcgtt

SEQ ID NO: 33856 - DNA, 16 bp, Artificial Sequence
  synthetic [barcode part1]
cacttatactctaggc

SEQ ID NO: 33857 - DNA, 16 bp, Artificial Sequence
  synthetic [barcode part1]
tcctaccttcgttgtg

SEQ ID NO: 33858 - DNA, 16 bp, Artificial Sequence
  synthetic [barcode part1]
ttgtggttcgaccaag

SEQ ID NO: 33859 - DNA, 16 bp, Artificial Sequence
  synthetic [barcode part1]
acgcaatcttcttgac

SEQ ID NO: 33860 - DNA, 16 bp, Artificial Sequence
  synthetic [barcode part1]
tcaaccaacgtacgtg

SEQ ID NO: 33861 - DNA, 16 bp, Artificial Sequence
  synthetic [barcode part1]
gcgtgaacaggttacg

SEQ ID NO: 33862 - DNA, 16 bp, Artificial Sequence
  synthetic [barcode part1]
caggtacgactacact

SEQ ID NO: 33863 - DNA, 16 bp, Artificial Sequence
  synthetic [barcode part1]
aagagtatcgtcagac

SEQ ID NO: 33864 - DNA, 16 bp, Artificial Sequence
  synthetic [barcode part1]
tgtgagtagtgtctgc

SEQ ID NO: 33865 - DNA, 16 bp, Artificial Sequence
  synthetic [barcode part1]
aggtcaggtacgtcag

SEQ ID NO: 33866 - DNA, 16 bp, Artificial Sequence
  synthetic [barcode part1]
attcctgacgattcgt

SEQ ID NO: 33867 - DNA, 16 bp, Artificial Sequence
  synthetic [barcode part1]
atagagtctcgaacag

SEQ ID NO: 33868 - DNA, 16 bp, Artificial Sequence
  synthetic [barcode part1]
tactgtgtgactggtg

SEQ ID NO: 33869 - DNA, 16 bp, Artificial Sequence
  synthetic [barcode part1]
taggaagtctcggtct

SEQ ID NO: 33870 - DNA, 16 bp, Artificial Sequence
  synthetic [barcode part1]
gagacgattgtcctac

SEQ ID NO: 33871 - DNA, 16 bp, Artificial Sequence
  synthetic [barcode part1]
gcctgaggtagtagac

SEQ ID NO: 33872 - DNA, 16 bp, Artificial Sequence
  synthetic [barcode part1]
tccgcgttacacttct

SEQ ID NO: 33873 - DNA, 16 bp, Artificial Sequence
  synthetic [barcode part1]
ttcaggttccggttcg

SEQ ID NO: 33874 - DNA, 16 bp, Artificial Sequence
  synthetic [barcode part1]
atatcctccgagttac

SEQ ID NO: 33875 - DNA, 16 bp, Artificial Sequence
  synthetic [barcode part1]
gtataatatcggcgcc

SEQ ID NO: 33876 - DNA, 16 bp, Artificial Sequence
  synthetic [barcode part1]
cgaatattggtggagt

SEQ ID NO: 33877 - DNA, 16 bp, Artificial Sequence
  synthetic [barcode part1]
gtcaactaggaccttg

SEQ ID NO: 33878 - DNA, 16 bp, Artificial Sequence
  synthetic [barcode part1]
gaaggcgacaggaatt

SEQ ID NO: 33879 - DNA, 16 bp, Artificial Sequence
  synthetic [barcode part1]
cgttcgtctacttacc

SEQ ID NO: 33880 - DNA, 16 bp, Artificial Sequence
  synthetic [barcode part1]
gtgcagacagagatag

SEQ ID NO: 33881 - DNA, 16 bp, Artificial Sequence
  synthetic [barcode part1]
cggataccacgaactt

SEQ ID NO: 33882 - DNA, 16 bp, Artificial Sequence
  synthetic [barcode part1]
gtcgtccacgagttct

SEQ ID NO: 33883 - DNA, 16 bp, Artificial Sequence
  synthetic [barcode part1]
caatacgtcagtacgc

SEQ ID NO: 33884 - DNA, 16 bp, Artificial Sequence
  synthetic [barcode part1]
cacgaattcgtcttac

SEQ ID NO: 33885 - DNA, 16 bp, Artificial Sequence
  synthetic [barcode part1]
tgtccgcgaataggtt

SEQ ID NO: 33886 - DNA, 16 bp, Artificial Sequence
  synthetic [barcode part1]
cagtcttaccacgcgt

SEQ ID NO: 33887 - DNA, 16 bp, Artificial Sequence
  synthetic [barcode part1]
tactgttcgtctcgtc

SEQ ID NO: 33888 - DNA, 16 bp, Artificial Sequence
  synthetic [barcode part1]
gcgaggaattggacct

SEQ ID NO: 33889 - DNA, 16 bp, Artificial Sequence
  synthetic [barcode part1]
agtggccgtacttctc

SEQ ID NO: 33890 - DNA, 16 bp, Artificial Sequence
  synthetic [barcode part1]
ccacttgtgtcgtgac

SEQ ID NO: 33891 - DNA, 16 bp, Artificial Sequence
  synthetic [barcode part1]
caatctggtcttcgcg

SEQ ID NO: 33892 - DNA, 16 bp, Artificial Sequence
  synthetic [barcode part1]
tataacgtggacaggt

SEQ ID NO: 33893 - DNA, 16 bp, Artificial Sequence
  synthetic [barcode part1]
cactcctcgacttgag

SEQ ID NO: 33894 - DNA, 16 bp, Artificial Sequence
  synthetic [barcode part1]
tggacgagtagacaag

SEQ ID NO: 33895 - DNA, 16 bp, Artificial Sequence
  synthetic [barcode part1]
tgtagtcactgaagag

SEQ ID NO: 33896 - DNA, 16 bp, Artificial Sequence
  synthetic [barcode part1]
actatctgcctgtaac

SEQ ID NO: 33897 - DNA, 16 bp, Artificial Sequence
  synthetic [barcode part1]
attgcgaatccacttc

SEQ ID NO: 33898 - DNA, 16 bp, Artificial Sequence
  synthetic [barcode part1]
ttagttccaggagacc

SEQ ID NO: 33899 - DNA, 16 bp, Artificial Sequence
  synthetic [barcode part1]
tacagaactcctgcag

SEQ ID NO: 33900 - DNA, 16 bp, Artificial Sequence
  synthetic [barcode part1]
gaatcaagtcgatacg

SEQ ID NO: 33901 - DNA, 16 bp, Artificial Sequence
  synthetic [barcode part1]
atcggttattacggcg

SEQ ID NO: 33902 - DNA, 16 bp, Artificial Sequence
  synthetic [barcode part1]
tcactacactcacagt

SEQ ID NO: 33903 - DNA, 16 bp, Artificial Sequence
  synthetic [barcode part1]
tcgtctacgtcgcagt

SEQ ID NO: 33904 - DNA, 16 bp, Artificial Sequence
  synthetic [barcode part1]
gaatccgagtgtgtct

SEQ ID NO: 33905 - DNA, 16 bp, Artificial Sequence
  synthetic [barcode part1]
gatctgttagaacgag

SEQ ID NO: 33906 - DNA, 16 bp, Artificial Sequence
  synthetic [barcode part1]
gattgcaagtcagaac

SEQ ID NO: 33907 - DNA, 16 bp, Artificial Sequence
  synthetic [barcode part1]
agacctataagaggtc

SEQ ID NO: 33908 - DNA, 16 bp, Artificial Sequence
  synthetic [barcode part1]
aacttgcgataagacg

SEQ ID NO: 33909 - DNA, 16 bp, Artificial Sequence
  synthetic [barcode part1]
gtctgaactgtctcgc

SEQ ID NO: 33910 - DNA, 16 bp, Artificial Sequence
  synthetic [barcode part1]
gtcagttccgactaag

SEQ ID NO: 33911 - DNA, 16 bp, Artificial Sequence
  synthetic [barcode part1]
agtcaggttcgcgaag

SEQ ID NO: 33912 - DNA, 16 bp, Artificial Sequence
  synthetic [barcode part1]
aactgaagacgtactg

SEQ ID NO: 33913 - DNA, 16 bp, Artificial Sequence
  synthetic [barcode part1]
ttattgcctacaggtc

SEQ ID NO: 33914 - DNA, 16 bp, Artificial Sequence
  synthetic [barcode part1]
tcagaggtcttcagtg

SEQ ID NO: 33915 - DNA, 16 bp, Artificial Sequence
  synthetic [barcode part1]
ttcagagtgattggcc

SEQ ID NO: 33916 - DNA, 16 bp, Artificial Sequence
  synthetic [barcode part1]
gccttcggtctctatt

SEQ ID NO: 33917 - DNA, 16 bp, Artificial Sequence
  synthetic [barcode part1]
ccaagttgaccactag

SEQ ID NO: 33918 - DNA, 16 bp, Artificial Sequence
  synthetic [barcode part1]
ttgatctagtggcgac

SEQ ID NO: 33919 - DNA, 16 bp, Artificial Sequence
  synthetic [barcode part1]
gccttgcagtatactt

SEQ ID NO: 33920 - DNA, 16 bp, Artificial Sequence
  synthetic [barcode part1]
tacgaacagacaacac

SEQ ID NO: 33921 - DNA, 16 bp, Artificial Sequence
  synthetic [barcode part1]
tgcgagatctctgtag

SEQ ID NO: 33922 - DNA, 16 bp, Artificial Sequence
  synthetic [barcode part1]
gaagtagacgaacctt

SEQ ID NO: 33923 - DNA, 16 bp, Artificial Sequence
  synthetic [barcode part1]
ccacctaggaccttac

SEQ ID NO: 33924 - DNA, 16 bp, Artificial Sequence
  synthetic [barcode part1]
tactggtactgcacag

SEQ ID NO: 33925 - DNA, 16 bp, Artificial Sequence
  synthetic [barcode part1]
attgcctagactcact

SEQ ID NO: 33926 - DNA, 16 bp, Artificial Sequence
  synthetic [barcode part1]
gacggattctactcag

SEQ ID NO: 33927 - DNA, 16 bp, Artificial Sequence
  synthetic [barcode part1]
tgtgttggtgttgacg

SEQ ID NO: 33928 - DNA, 16 bp, Artificial Sequence
  synthetic [barcode part1]
ttggccgtaatcaacg

SEQ ID NO: 33929 - DNA, 16 bp, Artificial Sequence
  synthetic [barcode part1]
gcacaacacacactgt

SEQ ID NO: 33930 - DNA, 16 bp, Artificial Sequence
  synthetic [barcode part1]
gtattcctggcggtct

SEQ ID NO: 33931 - DNA, 16 bp, Artificial Sequence
  synthetic [barcode part1]
cgatatacgatcctct

SEQ ID NO: 33932 - DNA, 16 bp, Artificial Sequence
  synthetic [barcode part1]
actgtagaacgagtac

SEQ ID NO: 33933 - DNA, 16 bp, Artificial Sequence
  synthetic [barcode part1]
accaacgtccgactct

SEQ ID NO: 33934 - DNA, 16 bp, Artificial Sequence
  synthetic [barcode part1]
gagttgtcagagacgc

SEQ ID NO: 33935 - DNA, 16 bp, Artificial Sequence
  synthetic [barcode part1]
cctatcgtcgaatatc

SEQ ID NO: 33936 - DNA, 16 bp, Artificial Sequence
  synthetic [barcode part1]
cactaagttgcacttc

SEQ ID NO: 33937 - DNA, 16 bp, Artificial Sequence
  synthetic [barcode part1]
tggcacacgatcctct

SEQ ID NO: 33938 - DNA, 16 bp, Artificial Sequence
  synthetic [barcode part1]
tctgtcgagagtgatc

SEQ ID NO: 33939 - DNA, 16 bp, Artificial Sequence
  synthetic [barcode part1]
ccaagactgaggttct

SEQ ID NO: 33940 - DNA, 16 bp, Artificial Sequence
  synthetic [barcode part1]
tcagtcaaccacaacg

SEQ ID NO: 33941 - DNA, 16 bp, Artificial Sequence
  synthetic [barcode part1]
gagacaatcgtagact

SEQ ID NO: 33942 - DNA, 16 bp, Artificial Sequence
  synthetic [barcode part1]
ttattcgagattccgc

SEQ ID NO: 33943 - DNA, 16 bp, Artificial Sequence
  synthetic [barcode part1]
caacttgttgccgaag

SEQ ID NO: 33944 - DNA, 16 bp, Artificial Sequence
  synthetic [barcode part1]
acagttctcgtcagag

SEQ ID NO: 33945 - DNA, 16 bp, Artificial Sequence
  synthetic [barcode part1]
ttgcagtgactggttg

SEQ ID NO: 33946 - DNA, 16 bp, Artificial Sequence
  synthetic [barcode part1]
tgacctccgtaatcgc

SEQ ID NO: 33947 - DNA, 16 bp, Artificial Sequence
  synthetic [barcode part1]
cgaactgccaacagtt

SEQ ID NO: 33948 - DNA, 16 bp, Artificial Sequence
  synthetic [barcode part1]
gattcgaatcggatcc

SEQ ID NO: 33949 - DNA, 16 bp, Artificial Sequence
  synthetic [barcode part1]
tgagagacgcacaatt

SEQ ID NO: 33950 - DNA, 16 bp, Artificial Sequence
  synthetic [barcode part1]
tgccaccttgtatagt

SEQ ID NO: 33951 - DNA, 16 bp, Artificial Sequence
  synthetic [barcode part1]
gcacacgagttgattc

SEQ ID NO: 33952 - DNA, 16 bp, Artificial Sequence
  synthetic [barcode part1]
cactgtatctcctctg

SEQ ID NO: 33953 - DNA, 16 bp, Artificial Sequence
  synthetic [barcode part1]
tcttgcgaactcgacc

SEQ ID NO: 33954 - DNA, 16 bp, Artificial Sequence
  synthetic [barcode part1]
aataggacacgtcaac

SEQ ID NO: 33955 - DNA, 16 bp, Artificial Sequence
  synthetic [barcode part1]
tcgtagtgtcgatcag

SEQ ID NO: 33956 - DNA, 16 bp, Artificial Sequence
  synthetic [barcode part1]
actctatcgtcctacc

SEQ ID NO: 33957 - DNA, 16 bp, Artificial Sequence
  synthetic [barcode part1]
tacctcagtggtgagt

SEQ ID NO: 33958 - DNA, 16 bp, Artificial Sequence
  synthetic [barcode part1]
acgattcgaacacaag

SEQ ID NO: 33959 - DNA, 16 bp, Artificial Sequence
  synthetic [barcode part1]
gacctggtagtagttc

SEQ ID NO: 33960 - DNA, 16 bp, Artificial Sequence
  synthetic [barcode part1]
ccggcgatattgaact

SEQ ID NO: 33961 - DNA, 16 bp, Artificial Sequence
  synthetic [barcode part1]
tggagtcaagactcct

SEQ ID NO: 33962 - DNA, 16 bp, Artificial Sequence
  synthetic [barcode part1]
cgcgtggtcactactt

SEQ ID NO: 33963 - DNA, 16 bp, Artificial Sequence
  synthetic [barcode part1]
taacgcaagttgcacc

SEQ ID NO: 33964 - DNA, 16 bp, Artificial Sequence
  synthetic [barcode part1]
tgtcctatacctgagt

SEQ ID NO: 33965 - DNA, 16 bp, Artificial Sequence
  synthetic [barcode part1]
tggacgtgatctacgt

SEQ ID NO: 33966 - DNA, 16 bp, Artificial Sequence
  synthetic [barcode part1]
aagtgtacttcgtgcg

SEQ ID NO: 33967 - DNA, 16 bp, Artificial Sequence
  synthetic [barcode part1]
gactgcgaaggaactc

SEQ ID NO: 33968 - DNA, 16 bp, Artificial Sequence
  synthetic [barcode part1]
tcgtaggtatctcgtt

SEQ ID NO: 33969 - DNA, 16 bp, Artificial Sequence
  synthetic [barcode part1]
tcttaacgccaccttc

SEQ ID NO: 33970 - DNA, 16 bp, Artificial Sequence
  synthetic [barcode part1]
gataccgccagaatct

SEQ ID NO: 33971 - DNA, 16 bp, Artificial Sequence
  synthetic [barcode part1]
gagaccaggcctatag

SEQ ID NO: 33972 - DNA, 16 bp, Artificial Sequence
  synthetic [barcode part1]
agacaataaggtggcg

SEQ ID NO: 33973 - DNA, 16 bp, Artificial Sequence
  synthetic [barcode part1]
gcctgtgagaagtcag

SEQ ID NO: 33974 - DNA, 16 bp, Artificial Sequence
  synthetic [barcode part1]
gcgaccgaatcttcct

SEQ ID NO: 33975 - DNA, 16 bp, Artificial Sequence
  synthetic [barcode part1]
gtggattaatccgtgc

SEQ ID NO: 33976 - DNA, 16 bp, Artificial Sequence
  synthetic [barcode part1]
cagataccttcgccac

SEQ ID NO: 33977 - DNA, 16 bp, Artificial Sequence
  synthetic [barcode part1]
acagattcgacctctt

SEQ ID NO: 33978 - DNA, 16 bp, Artificial Sequence
  synthetic [barcode part1]
tctgactcgcgtgact

SEQ ID NO: 33979 - DNA, 16 bp, Artificial Sequence
  synthetic [barcode part1]
tgcaggtattccactt

SEQ ID NO: 33980 - DNA, 16 bp, Artificial Sequence
  synthetic [barcode part1]
tcgttagagaggcacg

SEQ ID NO: 33981 - DNA, 16 bp, Artificial Sequence
  synthetic [barcode part1]
agacggaacggtactc

SEQ ID NO: 33982 - DNA, 16 bp, Artificial Sequence
  synthetic [barcode part1]
cgtccttctggtagtg

SEQ ID NO: 33983 - DNA, 16 bp, Artificial Sequence
  synthetic [barcode part1]
cactgcgtgtaatacg

SEQ ID NO: 33984 - DNA, 16 bp, Artificial Sequence
  synthetic [barcode part1]
gtggagagattactac

SEQ ID NO: 33985 - DNA, 16 bp, Artificial Sequence
  synthetic [barcode part1]
tacacgatatcggcac

SEQ ID NO: 33986 - DNA, 16 bp, Artificial Sequence
  synthetic [barcode part1]
gccacgaattcgttcc

SEQ ID NO: 33987 - DNA, 16 bp, Artificial Sequence
  synthetic [barcode part1]
accgacaataaggtgt

SEQ ID NO: 33988 - DNA, 16 bp, Artificial Sequence
  synthetic [barcode part1]
aggtcgccaagagtac

SEQ ID NO: 33989 - DNA, 16 bp, Artificial Sequence
  synthetic [barcode part1]
gtccaatagagacgcg

SEQ ID NO: 33990 - DNA, 16 bp, Artificial Sequence
  synthetic [barcode part1]
gcaaggataactcggc

SEQ ID NO: 33991 - DNA, 16 bp, Artificial Sequence
  synthetic [barcode part1]
cggtcctactaatact

SEQ ID NO: 33992 - DNA, 16 bp, Artificial Sequence
  synthetic [barcode part1]
tagtctgtccacgtcg

SEQ ID NO: 33993 - DNA, 16 bp, Artificial Sequence
  synthetic [barcode part1]
gttccgtcaccttatc

SEQ ID NO: 33994 - DNA, 16 bp, Artificial Sequence
  synthetic [barcode part1]
tccgtgcgtatctctt

SEQ ID NO: 33995 - DNA, 16 bp, Artificial Sequence
  synthetic [barcode part1]
tagtcgtagtacaccg

SEQ ID NO: 33996 - DNA, 16 bp, Artificial Sequence
  synthetic [barcode part1]
aacggcctgcaagaac

SEQ ID NO: 33997 - DNA, 16 bp, Artificial Sequence
  synthetic [barcode part1]
gtagatcttggcacac

SEQ ID NO: 33998 - DNA, 16 bp, Artificial Sequence
  synthetic [barcode part1]
atatccgccgttccag

SEQ ID NO: 33999 - DNA, 16 bp, Artificial Sequence
  synthetic [barcode part1]
atcgtgtgtacggttg

SEQ ID NO: 34000 - DNA, 16 bp, Artificial Sequence
  synthetic [barcode part1]
actacacactgtcttg

SEQ ID NO: 34001 - DNA, 16 bp, Artificial Sequence
  synthetic [barcode part1]
cagtactaacggatag

SEQ ID NO: 34002 - DNA, 16 bp, Artificial Sequence
  synthetic [barcode part1]
ccttagttgtaggtct

SEQ ID NO: 34003 - DNA, 16 bp, Artificial Sequence
  synthetic [barcode part1]
tgtagacgcggtagac

SEQ ID NO: 34004 - DNA, 16 bp, Artificial Sequence
  synthetic [barcode part1]
ttgtctgtctggaact

SEQ ID NO: 34005 - DNA, 16 bp, Artificial Sequence
  synthetic [barcode part1]
tgccactgtaaccacc

SEQ ID NO: 34006 - DNA, 16 bp, Artificial Sequence
  synthetic [barcode part1]
acaccaaggttacacc

SEQ ID NO: 34007 - DNA, 16 bp, Artificial Sequence
  synthetic [barcode part1]
tatatccactcggcgc

SEQ ID NO: 34008 - DNA, 16 bp, Artificial Sequence
  synthetic [barcode part1]
tatccacctgcctact

SEQ ID NO: 34009 - DNA, 16 bp, Artificial Sequence
  synthetic [barcode part1]
caggatcagtcctagt

SEQ ID NO: 34010 - DNA, 16 bp, Artificial Sequence
  synthetic [barcode part1]
ccgaacgaatagaatc

SEQ ID NO: 34011 - DNA, 16 bp, Artificial Sequence
  synthetic [barcode part1]
tgaactctccaccacg

SEQ ID NO: 34012 - DNA, 16 bp, Artificial Sequence
  synthetic [barcode part1]
gaacggtgacctacag

SEQ ID NO: 34013 - DNA, 16 bp, Artificial Sequence
  synthetic [barcode part1]
cctcctagtggttgtg

SEQ ID NO: 34014 - DNA, 16 bp, Artificial Sequence
  synthetic [barcode part1]
actggtaatctcttgc

SEQ ID NO: 34015 - DNA, 16 bp, Artificial Sequence
  synthetic [barcode part1]
ttgtgtctgtcggatt

SEQ ID NO: 34016 - DNA, 16 bp, Artificial Sequence
  synthetic [barcode part1]
tacgatcggttgtgtg

SEQ ID NO: 34017 - DNA, 16 bp, Artificial Sequence
  synthetic [barcode part1]
aagtgatctcttggcg

SEQ ID NO: 34018 - DNA, 16 bp, Artificial Sequence
  synthetic [barcode part1]
aatacgacctggcgag

SEQ ID NO: 34019 - DNA, 16 bp, Artificial Sequence
  synthetic [barcode part1]
ttcgatcctgaggagt

SEQ ID NO: 34020 - DNA, 16 bp, Artificial Sequence
  synthetic [barcode part1]
agtcaggaagtcagag

SEQ ID NO: 34021 - DNA, 16 bp, Artificial Sequence
  synthetic [barcode part1]
tcaatcggaggttctg

SEQ ID NO: 34022 - DNA, 16 bp, Artificial Sequence
  synthetic [barcode part1]
tagtctcaggaggtct

SEQ ID NO: 34023 - DNA, 16 bp, Artificial Sequence
  synthetic [barcode part1]
tgcagagatcaagttg

SEQ ID NO: 34024 - DNA, 16 bp, Artificial Sequence
  synthetic [barcode part1]
tccacggaacaaggtg

SEQ ID NO: 34025 - DNA, 16 bp, Artificial Sequence
  synthetic [barcode part1]
cctgtgttgacctgac

SEQ ID NO: 34026 - DNA, 16 bp, Artificial Sequence
  synthetic [barcode part1]
cctgtcagtgtaattc

SEQ ID NO: 34027 - DNA, 16 bp, Artificial Sequence
  synthetic [barcode part1]
ttcaaccacgtcagtt

SEQ ID NO: 34028 - DNA, 16 bp, Artificial Sequence
  synthetic [barcode part1]
gattgtgcgattgcac

SEQ ID NO: 34029 - DNA, 16 bp, Artificial Sequence
  synthetic [barcode part1]
gtctagacctactgcc

SEQ ID NO: 34030 - DNA, 16 bp, Artificial Sequence
  synthetic [barcode part1]
actcgtccttactcac

SEQ ID NO: 34031 - DNA, 16 bp, Artificial Sequence
  synthetic [barcode part1]
tggccagatactacac

SEQ ID NO: 34032 - DNA, 16 bp, Artificial Sequence
  synthetic [barcode part1]
atagaagaaggtgcgc

SEQ ID NO: 34033 - DNA, 16 bp, Artificial Sequence
  synthetic [barcode part1]
gttccgtacttgaatc

SEQ ID NO: 34034 - DNA, 16 bp, Artificial Sequence
  synthetic [barcode part1]
gtctaccttattcgcc

SEQ ID NO: 34035 - DNA, 16 bp, Artificial Sequence
  synthetic [barcode part1]
aggaagacaacaccag

SEQ ID NO: 34036 - DNA, 16 bp, Artificial Sequence
  synthetic [barcode part1]
tccgtgtggttcgatc

SEQ ID NO: 34037 - DNA, 16 bp, Artificial Sequence
  synthetic [barcode part1]
acagtggagatcgaag

SEQ ID NO: 34038 - DNA, 16 bp, Artificial Sequence
  synthetic [barcode part1]
ttatctggtggtatcc

SEQ ID NO: 34039 - DNA, 16 bp, Artificial Sequence
  synthetic [barcode part1]
gtccaattacaggaag

SEQ ID NO: 34040 - DNA, 16 bp, Artificial Sequence
  synthetic [barcode part1]
gtagactgaggtggtc

SEQ ID NO: 34041 - DNA, 16 bp, Artificial Sequence
  synthetic [barcode part1]
ccacctgttgttcact

SEQ ID NO: 34042 - DNA, 16 bp, Artificial Sequence
  synthetic [barcode part1]
cactccggaacttatt

SEQ ID NO: 34043 - DNA, 16 bp, Artificial Sequence
  synthetic [barcode part1]
gcctaggaataaggcc

SEQ ID NO: 34044 - DNA, 16 bp, Artificial Sequence
  synthetic [barcode part1]
gcggcgtgttaattgt

SEQ ID NO: 34045 - DNA, 16 bp, Artificial Sequence
  synthetic [barcode part1]
cggaccagtacaagac

SEQ ID NO: 34046 - DNA, 16 bp, Artificial Sequence
  synthetic [barcode part1]
gatcttgaggcagacg

SEQ ID NO: 34047 - DNA, 16 bp, Artificial Sequence
  synthetic [barcode part1]
gtacctctcgaattac

SEQ ID NO: 34048 - DNA, 16 bp, Artificial Sequence
  synthetic [barcode part1]
tgtctattctaggacc

SEQ ID NO: 34049 - DNA, 16 bp, Artificial Sequence
  synthetic [barcode part1]
gtcgttcttatagacc

SEQ ID NO: 34050 - DNA, 16 bp, Artificial Sequence
  synthetic [barcode part1]
cgaaccagatcgttgt

SEQ ID NO: 34051 - DNA, 16 bp, Artificial Sequence
  synthetic [barcode part1]
tagtccttgcgcaatt

SEQ ID NO: 34052 - DNA, 16 bp, Artificial Sequence
  synthetic [barcode part1]
tagaccgccagattgt

SEQ ID NO: 34053 - DNA, 16 bp, Artificial Sequence
  synthetic [barcode part1]
tctcgaccacgtcaac

SEQ ID NO: 34054 - DNA, 16 bp, Artificial Sequence
  synthetic [barcode part1]
tgtctccgttgccaag

SEQ ID NO: 34055 - DNA, 16 bp, Artificial Sequence
  synthetic [barcode part1]
tccgcacttccgtatt

SEQ ID NO: 34056 - DNA, 16 bp, Artificial Sequence
  synthetic [barcode part1]
taatctcgccaacgcc

SEQ ID NO: 34057 - DNA, 16 bp, Artificial Sequence
  synthetic [barcode part1]
tgtcacacagtgtcag

SEQ ID NO: 34058 - DNA, 16 bp, Artificial Sequence
  synthetic [barcode part1]
cagatcggaggatatt

SEQ ID NO: 34059 - DNA, 16 bp, Artificial Sequence
  synthetic [barcode part1]
acaaccggagattagt

SEQ ID NO: 34060 - DNA, 16 bp, Artificial Sequence
  synthetic [barcode part1]
tacgcggaatagtggc

SEQ ID NO: 34061 - DNA, 16 bp, Artificial Sequence
  synthetic [barcode part1]
cggatcaagaggcact

SEQ ID NO: 34062 - DNA, 16 bp, Artificial Sequence
  synthetic [barcode part1]
agagagaggaaggaag

SEQ ID NO: 34063 - DNA, 16 bp, Artificial Sequence
  synthetic [barcode part1]
tagtcctcgtgtagtt

SEQ ID NO: 34064 - DNA, 16 bp, Artificial Sequence
  synthetic [barcode part1]
acggtgtcctcttctt

SEQ ID NO: 34065 - DNA, 16 bp, Artificial Sequence
  synthetic [barcode part1]
aacacctacctcttag

SEQ ID NO: 34066 - DNA, 16 bp, Artificial Sequence
  synthetic [barcode part1]
cgcacaagtaaccact

SEQ ID NO: 34067 - DNA, 16 bp, Artificial Sequence
  synthetic [barcode part1]
tcggagttaggactct

SEQ ID NO: 34068 - DNA, 16 bp, Artificial Sequence
  synthetic [barcode part1]
cctgaggcagtattac

SEQ ID NO: 34069 - DNA, 16 bp, Artificial Sequence
  synthetic [barcode part1]
acctcacaagtatctc

SEQ ID NO: 34070 - DNA, 16 bp, Artificial Sequence
  synthetic [barcode part1]
acgtcttggaggtgtt

SEQ ID NO: 34071 - DNA, 16 bp, Artificial Sequence
  synthetic [barcode part1]
cgtagtgagtgtcgtt

SEQ ID NO: 34072 - DNA, 16 bp, Artificial Sequence
  synthetic [barcode part1]
aagacggtacctaggc

SEQ ID NO: 34073 - DNA, 16 bp, Artificial Sequence
  synthetic [barcode part1]
gtgattccaagtcacg

SEQ ID NO: 34074 - DNA, 16 bp, Artificial Sequence
  synthetic [barcode part1]
tctgaggtgaccgatt

SEQ ID NO: 34075 - DNA, 16 bp, Artificial Sequence
  synthetic [barcode part1]
ttccgtacgatctagt

SEQ ID NO: 34076 - DNA, 16 bp, Artificial Sequence
  synthetic [barcode part1]
gtctcgtcactctatc

SEQ ID NO: 34077 - DNA, 16 bp, Artificial Sequence
  synthetic [barcode part1]
tgtgagtaggtggcac

SEQ ID NO: 34078 - DNA, 16 bp, Artificial Sequence
  synthetic [barcode part1]
gtgcgtgtgatcaatc

SEQ ID NO: 34079 - DNA, 16 bp, Artificial Sequence
  synthetic [barcode part1]
attacaattgcctgcc

SEQ ID NO: 34080 - DNA, 16 bp, Artificial Sequence
  synthetic [barcode part1]
ttgcacctctacgttc

SEQ ID NO: 34081 - DNA, 16 bp, Artificial Sequence
  synthetic [barcode part1]
gtgtgagattctcgtg

SEQ ID NO: 34082 - DNA, 16 bp, Artificial Sequence
  synthetic [barcode part1]
cgagatcactgactgt

SEQ ID NO: 34083 - DNA, 16 bp, Artificial Sequence
  synthetic [barcode part1]
gacgcacgaagaatcc

SEQ ID NO: 34084 - DNA, 16 bp, Artificial Sequence
  synthetic [barcode part1]
ccggaatactcgtcct

SEQ ID NO: 34085 - DNA, 16 bp, Artificial Sequence
  synthetic [barcode part1]
aactcgattggcaacc

SEQ ID NO: 34086 - DNA, 16 bp, Artificial Sequence
  synthetic [barcode part1]
gaggcgcaattcagtg

SEQ ID NO: 34087 - DNA, 16 bp, Artificial Sequence
  synthetic [barcode part1]
tagactgtgcacctcc

SEQ ID NO: 34088 - DNA, 16 bp, Artificial Sequence
  synthetic [barcode part1]
tgacctaggtgcagag

SEQ ID NO: 34089 - DNA, 16 bp, Artificial Sequence
  synthetic [barcode part1]
taggtgtcagtagaac

SEQ ID NO: 34090 - DNA, 16 bp, Artificial Sequence
  synthetic [barcode part1]
tctctgaacgtactgt

SEQ ID NO: 34091 - DNA, 16 bp, Artificial Sequence
  synthetic [barcode part1]
cacagatcaggtactc

SEQ ID NO: 34092 - DNA, 16 bp, Artificial Sequence
  synthetic [barcode part1]
accttattgtcaacgc

SEQ ID NO: 34093 - DNA, 16 bp, Artificial Sequence
  synthetic [barcode part1]
gtaagtacttgagacg

SEQ ID NO: 34094 - DNA, 16 bp, Artificial Sequence
  synthetic [barcode part1]
accaacaatcctccgc

SEQ ID NO: 34095 - DNA, 16 bp, Artificial Sequence
  synthetic [barcode part1]
gtgcgaccaattgtac

SEQ ID NO: 34096 - DNA, 16 bp, Artificial Sequence
  synthetic [barcode part1]
agattcctcctcttcg

SEQ ID NO: 34097 - DNA, 16 bp, Artificial Sequence
  synthetic [barcode part1]
gactctattcacctag

SEQ ID NO: 34098 - DNA, 16 bp, Artificial Sequence
  synthetic [barcode part1]
gaatcggcggttgtag

SEQ ID NO: 34099 - DNA, 16 bp, Artificial Sequence
  synthetic [barcode part1]
ccgagtaactccacct

SEQ ID NO: 34100 - DNA, 16 bp, Artificial Sequence
  synthetic [barcode part1]
taccagaaggtacggc

SEQ ID NO: 34101 - DNA, 16 bp, Artificial Sequence
  synthetic [barcode part1]
gcaaccaactggtgtt

SEQ ID NO: 34102 - DNA, 16 bp, Artificial Sequence
  synthetic [barcode part1]
aatctctgcgttcggc

SEQ ID NO: 34103 - DNA, 16 bp, Artificial Sequence
  synthetic [barcode part1]
gcaagttccttgtcgc

SEQ ID NO: 34104 - DNA, 16 bp, Artificial Sequence
  synthetic [barcode part1]
cacgacgagtattgtc

SEQ ID NO: 34105 - DNA, 16 bp, Artificial Sequence
  synthetic [barcode part1]
tcagacgacctcgtct

SEQ ID NO: 34106 - DNA, 16 bp, Artificial Sequence
  synthetic [barcode part1]
taagaactgagtcgtg

SEQ ID NO: 34107 - DNA, 16 bp, Artificial Sequence
  synthetic [barcode part1]
tggaatccacgatacc

SEQ ID NO: 34108 - DNA, 16 bp, Artificial Sequence
  synthetic [barcode part1]
caacttgacctggtag

SEQ ID NO: 34109 - DNA, 16 bp, Artificial Sequence
  synthetic [barcode part1]
tcgaatcgcgtggaag

SEQ ID NO: 34110 - DNA, 16 bp, Artificial Sequence
  synthetic [barcode part1]
caaccttcgtgcgact

SEQ ID NO: 34111 - DNA, 16 bp, Artificial Sequence
  synthetic [barcode part1]
gcgcggaactcaatag

SEQ ID NO: 34112 - DNA, 16 bp, Artificial Sequence
  synthetic [barcode part1]
gccggccaattaattg

SEQ ID NO: 34113 - DNA, 16 bp, Artificial Sequence
  synthetic [barcode part1]
tgccgtcagacactct

SEQ ID NO: 34114 - DNA, 16 bp, Artificial Sequence
  synthetic [barcode part1]
gttcgaacaccacctc

SEQ ID NO: 34115 - DNA, 16 bp, Artificial Sequence
  synthetic [barcode part1]
acacgatctccaattc

SEQ ID NO: 34116 - DNA, 16 bp, Artificial Sequence
  synthetic [barcode part1]
tacagacgtgagtctc

SEQ ID NO: 34117 - DNA, 16 bp, Artificial Sequence
  synthetic [barcode part1]
tctggagtcttgaggt

SEQ ID NO: 34118 - DNA, 16 bp, Artificial Sequence
  synthetic [barcode part1]
gtattgcactcacttg

SEQ ID NO: 34119 - DNA, 16 bp, Artificial Sequence
  synthetic [barcode part1]
tcaggatcttacttgc

SEQ ID NO: 34120 - DNA, 16 bp, Artificial Sequence
  synthetic [barcode part1]
tgacttgtcgtattcg

SEQ ID NO: 34121 - DNA, 16 bp, Artificial Sequence
  synthetic [barcode part1]
tccgaggagtcaattc

SEQ ID NO: 34122 - DNA, 16 bp, Artificial Sequence
  synthetic [barcode part1]
gtgtgacgatcggagt

SEQ ID NO: 34123 - DNA, 16 bp, Artificial Sequence
  synthetic [barcode part1]
acgacgaacgatcgtg

SEQ ID NO: 34124 - DNA, 16 bp, Artificial Sequence
  synthetic [barcode part1]
gcgaccggaagaactt

SEQ ID NO: 34125 - DNA, 16 bp, Artificial Sequence
  synthetic [barcode part1]
gtgatctcttacactg

SEQ ID NO: 34126 - DNA, 16 bp, Artificial Sequence
  synthetic [barcode part1]
gaggatcgtgtcaacg

SEQ ID NO: 34127 - DNA, 16 bp, Artificial Sequence
  synthetic [barcode part1]
ttgcaacacgtacacg

SEQ ID NO: 34128 - DNA, 16 bp, Artificial Sequence
  synthetic [barcode part1]
gagtgaatctggagtt

SEQ ID NO: 34129 - DNA, 16 bp, Artificial Sequence
  synthetic [barcode part1]
gtctgatagaggtgcg

SEQ ID NO: 34130 - DNA, 16 bp, Artificial Sequence
  synthetic [barcode part1]
tctggatcaccttgcg

SEQ ID NO: 34131 - DNA, 16 bp, Artificial Sequence
  synthetic [barcode part1]
gccgagtgaacacaac

SEQ ID NO: 34132 - DNA, 16 bp, Artificial Sequence
  synthetic [barcode part1]
attattgaccggaccg

SEQ ID NO: 34133 - DNA, 16 bp, Artificial Sequence
  synthetic [barcode part1]
tcggcggtatctctgt

SEQ ID NO: 34134 - DNA, 16 bp, Artificial Sequence
  synthetic [barcode part1]
gtgtaacaactgagac

SEQ ID NO: 34135 - DNA, 16 bp, Artificial Sequence
  synthetic [barcode part1]
gtatcaacgcaggtct

SEQ ID NO: 34136 - DNA, 16 bp, Artificial Sequence
  synthetic [barcode part1]
tgttgtctgaactcgt

SEQ ID NO: 34137 - DNA, 16 bp, Artificial Sequence
  synthetic [barcode part1]
gaactgtcgttgagtc

SEQ ID NO: 34138 - DNA, 16 bp, Artificial Sequence
  synthetic [barcode part1]
ttcacttggtaccgcg

SEQ ID NO: 34139 - DNA, 16 bp, Artificial Sequence
  synthetic [barcode part1]
gttcgtataatcctcg

SEQ ID NO: 34140 - DNA, 16 bp, Artificial Sequence
  synthetic [barcode part1]
cggaactaggaagagt

SEQ ID NO: 34141 - DNA, 16 bp, Artificial Sequence
  synthetic [barcode part1]
gttaacggtcctccac

SEQ ID NO: 34142 - DNA, 16 bp, Artificial Sequence
  synthetic [barcode part1]
tcttatcgtgacggag

SEQ ID NO: 34143 - DNA, 16 bp, Artificial Sequence
  synthetic [barcode part1]
ccagtagataaggact

SEQ ID NO: 34144 - DNA, 16 bp, Artificial Sequence
  synthetic [barcode part1]
gttgtgtacgtccaag

SEQ ID NO: 34145 - DNA, 16 bp, Artificial Sequence
  synthetic [barcode part1]
tactggttgcaaccag

SEQ ID NO: 34146 - DNA, 16 bp, Artificial Sequence
  synthetic [barcode part1]
acgtgataggatcggc

SEQ ID NO: 34147 - DNA, 16 bp, Artificial Sequence
  synthetic [barcode part1]
cagaattcgcggtgtt

SEQ ID NO: 34148 - DNA, 16 bp, Artificial Sequence
  synthetic [barcode part1]
gtaacacactgatcgc

SEQ ID NO: 34149 - DNA, 16 bp, Artificial Sequence
  synthetic [barcode part1]
gaacaccgaactcgtt

SEQ ID NO: 34150 - DNA, 16 bp, Artificial Sequence
  synthetic [barcode part1]
gcagtacttaaggcct

SEQ ID NO: 34151 - DNA, 16 bp, Artificial Sequence
  synthetic [barcode part1]
gaatcgcaggtcactt

SEQ ID NO: 34152 - DNA, 16 bp, Artificial Sequence
  synthetic [barcode part1]
tgaacaactcagaacg

SEQ ID NO: 34153 - DNA, 16 bp, Artificial Sequence
  synthetic [barcode part1]
acacaacgtgtgttgc

SEQ ID NO: 34154 - DNA, 16 bp, Artificial Sequence
  synthetic [barcode part1]
agtaccaacacacacc

SEQ ID NO: 34155 - DNA, 16 bp, Artificial Sequence
  synthetic [barcode part1]
tgcgagaccagtaacg

SEQ ID NO: 34156 - DNA, 16 bp, Artificial Sequence
  synthetic [barcode part1]
tcaagtgaggtggtgc

SEQ ID NO: 34157 - DNA, 16 bp, Artificial Sequence
  synthetic [barcode part1]
acgttgtgtgacgttg

SEQ ID NO: 34158 - DNA, 16 bp, Artificial Sequence
  synthetic [barcode part1]
cgattcaggcgtagag

SEQ ID NO: 34159 - DNA, 16 bp, Artificial Sequence
  synthetic [barcode part1]
gcacaacgtacgttgt

SEQ ID NO: 34160 - DNA, 16 bp, Artificial Sequence
  synthetic [barcode part1]
cactacagtcgactag

SEQ ID NO: 34161 - DNA, 16 bp, Artificial Sequence
  synthetic [barcode part1]
atatcctagttaccgc

SEQ ID NO: 34162 - DNA, 16 bp, Artificial Sequence
  synthetic [barcode part1]
gcaacgcaacttcaac

SEQ ID NO: 34163 - DNA, 16 bp, Artificial Sequence
  synthetic [barcode part1]
tggtagtctggcaatc

SEQ ID NO: 34164 - DNA, 16 bp, Artificial Sequence
  synthetic [barcode part1]
aggccggtcttaattg

SEQ ID NO: 34165 - DNA, 16 bp, Artificial Sequence
  synthetic [barcode part1]
tcgtaggcgtctcact

SEQ ID NO: 34166 - DNA, 16 bp, Artificial Sequence
  synthetic [barcode part1]
cgtcgactcaattccg

SEQ ID NO: 34167 - DNA, 16 bp, Artificial Sequence
  synthetic [barcode part1]
tctgaaggcgttacac

SEQ ID NO: 34168 - DNA, 16 bp, Artificial Sequence
  synthetic [barcode part1]
ttattccgcgtccgag

SEQ ID NO: 34169 - DNA, 16 bp, Artificial Sequence
  synthetic [barcode part1]
taggtgttgtggatcc

SEQ ID NO: 34170 - DNA, 16 bp, Artificial Sequence
  synthetic [barcode part1]
cgatatcagacggacg

SEQ ID NO: 34171 - DNA, 16 bp, Artificial Sequence
  synthetic [barcode part1]
gagtccgattcttcgc

SEQ ID NO: 34172 - DNA, 16 bp, Artificial Sequence
  synthetic [barcode part1]
tatccacggattctgt

SEQ ID NO: 34173 - DNA, 16 bp, Artificial Sequence
  synthetic [barcode part1]
cacctattgttgcagt

SEQ ID NO: 34174 - DNA, 16 bp, Artificial Sequence
  synthetic [barcode part1]
tactgtcgcgaccgtt

SEQ ID NO: 34175 - DNA, 16 bp, Artificial Sequence
  synthetic [barcode part1]
gcgataggatacgtcg

SEQ ID NO: 34176 - DNA, 16 bp, Artificial Sequence
  synthetic [barcode part1]
tgatacggaggatcgc

SEQ ID NO: 34177 - DNA, 16 bp, Artificial Sequence
  synthetic [barcode part1]
acaactactctctggt

SEQ ID NO: 34178 - DNA, 16 bp, Artificial Sequence
  synthetic [barcode part1]
acctagactgtctcgc

SEQ ID NO: 34179 - DNA, 16 bp, Artificial Sequence
  synthetic [barcode part1]
gttgtagtgttcgttc

SEQ ID NO: 34180 - DNA, 16 bp, Artificial Sequence
  synthetic [barcode part1]
caagttgtgacctgac

SEQ ID NO: 34181 - DNA, 16 bp, Artificial Sequence
  synthetic [barcode part1]
aacgttaggtcctggt

SEQ ID NO: 34182 - DNA, 16 bp, Artificial Sequence
  synthetic [barcode part1]
cgaggccttaagatct

SEQ ID NO: 34183 - DNA, 16 bp, Artificial Sequence
  synthetic [barcode part1]
tgaccaactagagtcc

SEQ ID NO: 34184 - DNA, 16 bp, Artificial Sequence
  synthetic [barcode part1]
aattcggaatcgccac

SEQ ID NO: 34185 - DNA, 16 bp, Artificial Sequence
  synthetic [barcode part1]
gtgactacgcaactac

SEQ ID NO: 34186 - DNA, 16 bp, Artificial Sequence
  synthetic [barcode part1]
attgtgcaggacgacg

SEQ ID NO: 34187 - DNA, 16 bp, Artificial Sequence
  synthetic [barcode part1]
gaggcgaaccttactt

SEQ ID NO: 34188 - DNA, 16 bp, Artificial Sequence
  synthetic [barcode part1]
tatacctggactactc

SEQ ID NO: 34189 - DNA, 16 bp, Artificial Sequence
  synthetic [barcode part1]
tgattggcaacgtcac

SEQ ID NO: 34190 - DNA, 16 bp, Artificial Sequence
  synthetic [barcode part1]
tgcagttccttatcag

SEQ ID NO: 34191 - DNA, 16 bp, Artificial Sequence
  synthetic [barcode part1]
gaacactgatagagtc

SEQ ID NO: 34192 - DNA, 16 bp, Artificial Sequence
  synthetic [barcode part1]
acgcaagatctagtag

SEQ ID NO: 34193 - DNA, 16 bp, Artificial Sequence
  synthetic [barcode part1]
gaacaatcggttctcg

SEQ ID NO: 34194 - DNA, 16 bp, Artificial Sequence
  synthetic [barcode part1]
acttctgtaccgaact

SEQ ID NO: 34195 - DNA, 16 bp, Artificial Sequence
  synthetic [barcode part1]
tgataatcctccgcgc

SEQ ID NO: 34196 - DNA, 16 bp, Artificial Sequence
  synthetic [barcode part1]
acactcaccgccttag

SEQ ID NO: 34197 - DNA, 16 bp, Artificial Sequence
  synthetic [barcode part1]
tggtaattgcacctct

SEQ ID NO: 34198 - DNA, 16 bp, Artificial Sequence
  synthetic [barcode part1]
gaacgtgtacaaggag

SEQ ID NO: 34199 - DNA, 16 bp, Artificial Sequence
  synthetic [barcode part1]
taattagtcggccgac

SEQ ID NO: 34200 - DNA, 16 bp, Artificial Sequence
  synthetic [barcode part1]
acgacagattcaggcg

SEQ ID NO: 34201 - DNA, 16 bp, Artificial Sequence
  synthetic [barcode part1]
tctatcaggaagtcgc

SEQ ID NO: 34202 - DNA, 16 bp, Artificial Sequence
  synthetic [barcode part1]
ttcgtataccgttgac

SEQ ID NO: 34203 - DNA, 16 bp, Artificial Sequence
  synthetic [barcode part1]
acggttacacgactac

SEQ ID NO: 34204 - DNA, 16 bp, Artificial Sequence
  synthetic [barcode part1]
actcaaccgatagtcg

SEQ ID NO: 34205 - DNA, 16 bp, Artificial Sequence
  synthetic [barcode part1]
taagattccagtcggc

SEQ ID NO: 34206 - DNA, 16 bp, Artificial Sequence
  synthetic [barcode part1]
cacaggtagactcact

SEQ ID NO: 34207 - DNA, 16 bp, Artificial Sequence
  synthetic [barcode part1]
caacgtagaggcagtc

SEQ ID NO: 34208 - DNA, 16 bp, Artificial Sequence
  synthetic [barcode part1]
gcacaataccgatacc

SEQ ID NO: 34209 - DNA, 16 bp, Artificial Sequence
  synthetic [barcode part1]
cagacagtgttcgttg

SEQ ID NO: 34210 - DNA, 16 bp, Artificial Sequence
  synthetic [barcode part1]
ttagaccgacctagtg

SEQ ID NO: 34211 - DNA, 16 bp, Artificial Sequence
  synthetic [barcode part1]
attggcagacgtgttc

SEQ ID NO: 34212 - DNA, 16 bp, Artificial Sequence
  synthetic [barcode part1]
tgccggagaattactc

SEQ ID NO: 34213 - DNA, 16 bp, Artificial Sequence
  synthetic [barcode part1]
tgcctggtgataggag

SEQ ID NO: 34214 - DNA, 16 bp, Artificial Sequence
  synthetic [barcode part1]
ccaacgcggaactaag

SEQ ID NO: 34215 - DNA, 16 bp, Artificial Sequence
  synthetic [barcode part1]
atactggttccgttac

SEQ ID NO: 34216 - DNA, 16 bp, Artificial Sequence
  synthetic [barcode part1]
cctgtgcggtctaact

SEQ ID NO: 34217 - DNA, 16 bp, Artificial Sequence
  synthetic [barcode part1]
gaggagtgtgattatc

SEQ ID NO: 34218 - DNA, 16 bp, Artificial Sequence
  synthetic [barcode part1]
tccgcgtccgacaatt

SEQ ID NO: 34219 - DNA, 16 bp, Artificial Sequence
  synthetic [barcode part1]
caggagacgactgtac

SEQ ID NO: 34220 - DNA, 16 bp, Artificial Sequence
  synthetic [barcode part1]
tattgatctggttccg

SEQ ID NO: 34221 - DNA, 16 bp, Artificial Sequence
  synthetic [barcode part1]
tataccttcacgcctc

SEQ ID NO: 34222 - DNA, 16 bp, Artificial Sequence
  synthetic [barcode part1]
taacggtactatcggc

SEQ ID NO: 34223 - DNA, 16 bp, Artificial Sequence
  synthetic [barcode part1]
cctgtcaacacctgac

SEQ ID NO: 34224 - DNA, 16 bp, Artificial Sequence
  synthetic [barcode part1]
accttgttgagttcgt

SEQ ID NO: 34225 - DNA, 16 bp, Artificial Sequence
  synthetic [barcode part1]
aattaaccgcacacgc

SEQ ID NO: 34226 - DNA, 16 bp, Artificial Sequence
  synthetic [barcode part1]
aactcggccagattgt

SEQ ID NO: 34227 - DNA, 16 bp, Artificial Sequence
  synthetic [barcode part1]
cgtcgacttcctcaag

SEQ ID NO: 34228 - DNA, 16 bp, Artificial Sequence
  synthetic [barcode part1]
taagtgtatcggaggt

SEQ ID NO: 34229 - DNA, 16 bp, Artificial Sequence
  synthetic [barcode part1]
gcagaagtcctatacc

SEQ ID NO: 34230 - DNA, 16 bp, Artificial Sequence
  synthetic [barcode part1]
acgtactccgtgtaag

SEQ ID NO: 34231 - DNA, 16 bp, Artificial Sequence
  synthetic [barcode part1]
aaggtggagtacttac

SEQ ID NO: 34232 - DNA, 16 bp, Artificial Sequence
  synthetic [barcode part1]
aaccgatccaaccaac

SEQ ID NO: 34233 - DNA, 16 bp, Artificial Sequence
  synthetic [barcode part1]
attccttctggtcctg

SEQ ID NO: 34234 - DNA, 16 bp, Artificial Sequence
  synthetic [barcode part1]
acgttaggattcgcac

SEQ ID NO: 34235 - DNA, 16 bp, Artificial Sequence
  synthetic [barcode part1]
tccagagtaacaccgt

SEQ ID NO: 34236 - DNA, 16 bp, Artificial Sequence
  synthetic [barcode part1]
tgagtatctggcacgt

SEQ ID NO: 34237 - DNA, 16 bp, Artificial Sequence
  synthetic [barcode part1]
gtccgtgtaacttccg

SEQ ID NO: 34238 - DNA, 16 bp, Artificial Sequence
  synthetic [barcode part1]
tcgaacttggcagttg

SEQ ID NO: 34239 - DNA, 16 bp, Artificial Sequence
  synthetic [barcode part1]
caacaacctccgtgtc

SEQ ID NO: 34240 - DNA, 16 bp, Artificial Sequence
  synthetic [barcode part1]
tagttattgtctcgcg

SEQ ID NO: 34241 - DNA, 16 bp, Artificial Sequence
  synthetic [barcode part1]
tgtgcgacactccact

SEQ ID NO: 34242 - DNA, 16 bp, Artificial Sequence
  synthetic [barcode part1]
gtggcctattcgatag

SEQ ID NO: 34243 - DNA, 16 bp, Artificial Sequence
  synthetic [barcode part1]
tgcctgttcgtggtac

SEQ ID NO: 34244 - DNA, 16 bp, Artificial Sequence
  synthetic [barcode part1]
cgtcaggtattgagtc

SEQ ID NO: 34245 - DNA, 16 bp, Artificial Sequence
  synthetic [barcode part1]
cacaaggcaattcaag

SEQ ID NO: 34246 - DNA, 16 bp, Artificial Sequence
  synthetic [barcode part1]
gactaggaatacactg

SEQ ID NO: 34247 - DNA, 16 bp, Artificial Sequence
  synthetic [barcode part1]
ttctatcggtatccag

SEQ ID NO: 34248 - DNA, 16 bp, Artificial Sequence
  synthetic [barcode part1]
actcgtacaacagaag

SEQ ID NO: 34249 - DNA, 16 bp, Artificial Sequence
  synthetic [barcode part1]
gagttgcaagtcacct

SEQ ID NO: 34250 - DNA, 16 bp, Artificial Sequence
  synthetic [barcode part1]
tctcagaagtgtcacg

SEQ ID NO: 34251 - DNA, 16 bp, Artificial Sequence
  synthetic [barcode part1]
aacgtctactccttag

SEQ ID NO: 34252 - DNA, 16 bp, Artificial Sequence
  synthetic [barcode part1]
tgtaagtggtgcctgt

SEQ ID NO: 34253 - DNA, 16 bp, Artificial Sequence
  synthetic [barcode part1]
tggtacaaggacggtc

SEQ ID NO: 34254 - DNA, 16 bp, Artificial Sequence
  synthetic [barcode part1]
agagacgcggattacc

SEQ ID NO: 34255 - DNA, 16 bp, Artificial Sequence
  synthetic [barcode part1]
taccagatccgcgttc

SEQ ID NO: 34256 - DNA, 16 bp, Artificial Sequence
  synthetic [barcode part1]
taaggtaaggtactcg

SEQ ID NO: 34257 - DNA, 16 bp, Artificial Sequence
  synthetic [barcode part1]
actcctgcgaagatac

SEQ ID NO: 34258 - DNA, 16 bp, Artificial Sequence
  synthetic [barcode part1]
ccttgcgtcggtaact

SEQ ID NO: 34259 - DNA, 16 bp, Artificial Sequence
  synthetic [barcode part1]
tggtactcagaatccg

SEQ ID NO: 34260 - DNA, 16 bp, Artificial Sequence
  synthetic [barcode part1]
cactgaactaccagac

SEQ ID NO: 34261 - DNA, 16 bp, Artificial Sequence
  synthetic [barcode part1]
acgaacggagttccag

SEQ ID NO: 34262 - DNA, 16 bp, Artificial Sequence
  synthetic [barcode part1]
ccgaagtctacctatt

SEQ ID NO: 34263 - DNA, 16 bp, Artificial Sequence
  synthetic [barcode part1]
tccgatcttcttcgac

SEQ ID NO: 34264 - DNA, 16 bp, Artificial Sequence
  synthetic [barcode part1]
acgagactgagtattg

SEQ ID NO: 34265 - DNA, 16 bp, Artificial Sequence
  synthetic [barcode part1]
gagtgtcctgtcctgt

SEQ ID NO: 34266 - DNA, 16 bp, Artificial Sequence
  synthetic [barcode part1]
attgataccgccgtcc

SEQ ID NO: 34267 - DNA, 16 bp, Artificial Sequence
  synthetic [barcode part1]
gtgttaggccactctc

SEQ ID NO: 34268 - DNA, 16 bp, Artificial Sequence
  synthetic [barcode part1]
gccacaactacttact

SEQ ID NO: 34269 - DNA, 16 bp, Artificial Sequence
  synthetic [barcode part1]
taacttacgtcggacg

SEQ ID NO: 34270 - DNA, 16 bp, Artificial Sequence
  synthetic [barcode part1]
gacttgtacaggttcg

SEQ ID NO: 34271 - DNA, 16 bp, Artificial Sequence
  synthetic [barcode part1]
tcggcaagacagtctt

SEQ ID NO: 34272 - DNA, 16 bp, Artificial Sequence
  synthetic [barcode part1]
cggtcgaatatcgtac

SEQ ID NO: 34273 - DNA, 16 bp, Artificial Sequence
  synthetic [barcode part1]
gcactctctctgtatc

SEQ ID NO: 34274 - DNA, 16 bp, Artificial Sequence
  synthetic [barcode part1]
gattcactaccgtccg

SEQ ID NO: 34275 - DNA, 16 bp, Artificial Sequence
  synthetic [barcode part1]
cgcacagttactattc

SEQ ID NO: 34276 - DNA, 16 bp, Artificial Sequence
  synthetic [barcode part1]
aagactccgagattcc

SEQ ID NO: 34277 - DNA, 16 bp, Artificial Sequence
  synthetic [barcode part1]
cctgatccgtaaccac

SEQ ID NO: 34278 - DNA, 16 bp, Artificial Sequence
  synthetic [barcode part1]
tccgttaaccgtctct

SEQ ID NO: 34279 - DNA, 16 bp, Artificial Sequence
  synthetic [barcode part1]
tcagtagattctcgtc

SEQ ID NO: 34280 - DNA, 16 bp, Artificial Sequence
  synthetic [barcode part1]
ttctaacaatccacgc

SEQ ID NO: 34281 - DNA, 16 bp, Artificial Sequence
  synthetic [barcode part1]
cgttgtatcggaactg

SEQ ID NO: 34282 - DNA, 16 bp, Artificial Sequence
  synthetic [barcode part1]
cagtaacgttaccgac

SEQ ID NO: 34283 - DNA, 16 bp, Artificial Sequence
  synthetic [barcode part1]
cggaagacagtgtgtc

SEQ ID NO: 34284 - DNA, 16 bp, Artificial Sequence
  synthetic [barcode part1]
taggttgcctcgtacc

SEQ ID NO: 34285 - DNA, 16 bp, Artificial Sequence
  synthetic [barcode part1]
tccagatcgagttcag

SEQ ID NO: 34286 - DNA, 16 bp, Artificial Sequence
  synthetic [barcode part1]
ccacaagatctggact

SEQ ID NO: 34287 - DNA, 16 bp, Artificial Sequence
  synthetic [barcode part1]
ttctggccgtgtcaac

SEQ ID NO: 34288 - DNA, 16 bp, Artificial Sequence
  synthetic [barcode part1]
atcgtacgtcactccg

SEQ ID NO: 34289 - DNA, 16 bp, Artificial Sequence
  synthetic [barcode part1]
aatcagaagtgcgttg

SEQ ID NO: 34290 - DNA, 16 bp, Artificial Sequence
  synthetic [barcode part1]
aaggacgcggattgtc

SEQ ID NO: 34291 - DNA, 16 bp, Artificial Sequence
  synthetic [barcode part1]
tccgaccaaggaatct

SEQ ID NO: 34292 - DNA, 16 bp, Artificial Sequence
  synthetic [barcode part1]
ttatccgtggagttct

SEQ ID NO: 34293 - DNA, 16 bp, Artificial Sequence
  synthetic [barcode part1]
acgtaacggtctctcc

SEQ ID NO: 34294 - DNA, 16 bp, Artificial Sequence
  synthetic [barcode part1]
gcaactacaatcgcac

SEQ ID NO: 34295 - DNA, 16 bp, Artificial Sequence
  synthetic [barcode part1]
agttcacacggacttg

SEQ ID NO: 34296 - DNA, 16 bp, Artificial Sequence
  synthetic [barcode part1]
atacaataggatcggc

SEQ ID NO: 34297 - DNA, 16 bp, Artificial Sequence
  synthetic [barcode part1]
ccaagtattcgagtgc

SEQ ID NO: 34298 - DNA, 16 bp, Artificial Sequence
  synthetic [barcode part1]
acgcgtctactctacg

SEQ ID NO: 34299 - DNA, 16 bp, Artificial Sequence
  synthetic [barcode part1]
tcaagtggtaggttcc

SEQ ID NO: 34300 - DNA, 16 bp, Artificial Sequence
  synthetic [barcode part1]
caaggtgtcgtgtgag

SEQ ID NO: 34301 - DNA, 16 bp, Artificial Sequence
  synthetic [barcode part1]
acgtgacggagtcagt

SEQ ID NO: 34302 - DNA, 16 bp, Artificial Sequence
  synthetic [barcode part1]
ccgataattacgtctc

SEQ ID NO: 34303 - DNA, 16 bp, Artificial Sequence
  synthetic [barcode part1]
aggaatagagttgtcc

SEQ ID NO: 34304 - DNA, 16 bp, Artificial Sequence
  synthetic [barcode part1]
ttggttcgtctctcgt

SEQ ID NO: 34305 - DNA, 16 bp, Artificial Sequence
  synthetic [barcode part1]
aagtaccttcggacac

SEQ ID NO: 34306 - DNA, 16 bp, Artificial Sequence
  synthetic [barcode part1]
attggtctaacgccag

SEQ ID NO: 34307 - DNA, 16 bp, Artificial Sequence
  synthetic [barcode part1]
tgtcgtcgtccaagtc

SEQ ID NO: 34308 - DNA, 16 bp, Artificial Sequence
  synthetic [barcode part1]
tggccactgttaacag

SEQ ID NO: 34309 - DNA, 16 bp, Artificial Sequence
  synthetic [barcode part1]
atccagaaggttcacc

SEQ ID NO: 34310 - DNA, 16 bp, Artificial Sequence
  synthetic [barcode part1]
cagaaggaatcaggac

SEQ ID NO: 34311 - DNA, 16 bp, Artificial Sequence
  synthetic [barcode part1]
acacactacaactgcg

SEQ ID NO: 34312 - DNA, 16 bp, Artificial Sequence
  synthetic [barcode part1]
ttcggccgtcagtgtt

SEQ ID NO: 34313 - DNA, 16 bp, Artificial Sequence
  synthetic [barcode part1]
atcttcagtgatccac

SEQ ID NO: 34314 - DNA, 16 bp, Artificial Sequence
  synthetic [barcode part1]
tggtgcgtagttcctc

SEQ ID NO: 34315 - DNA, 16 bp, Artificial Sequence
  synthetic [barcode part1]
aagactcctcagaacc

SEQ ID NO: 34316 - DNA, 16 bp, Artificial Sequence
  synthetic [barcode part1]
aatacgcgttagtgcc

SEQ ID NO: 34317 - DNA, 16 bp, Artificial Sequence
  synthetic [barcode part1]
tgcgtgcaatcttgag

SEQ ID NO: 34318 - DNA, 16 bp, Artificial Sequence
  synthetic [barcode part1]
gcagaaggtcgttgac

SEQ ID NO: 34319 - DNA, 16 bp, Artificial Sequence
  synthetic [barcode part1]
gaactggccttagttg

SEQ ID NO: 34320 - DNA, 16 bp, Artificial Sequence
  synthetic [barcode part1]
tagtctcaggatcggt

SEQ ID NO: 34321 - DNA, 16 bp, Artificial Sequence
  synthetic [barcode part1]
gcgagttgattcgtgt

SEQ ID NO: 34322 - DNA, 16 bp, Artificial Sequence
  synthetic [barcode part1]
aggaggtgcaagatac

SEQ ID NO: 34323 - DNA, 16 bp, Artificial Sequence
  synthetic [barcode part1]
atattggtcttgccgt

SEQ ID NO: 34324 - DNA, 16 bp, Artificial Sequence
  synthetic [barcode part1]
acgtgactgcacgatt

SEQ ID NO: 34325 - DNA, 16 bp, Artificial Sequence
  synthetic [barcode part1]
gtgaccacacacagtt

SEQ ID NO: 34326 - DNA, 16 bp, Artificial Sequence
  synthetic [barcode part1]
aatcgtcaatacggag

SEQ ID NO: 34327 - DNA, 16 bp, Artificial Sequence
  synthetic [barcode part1]
tacgtccagacacaac

SEQ ID NO: 34328 - DNA, 16 bp, Artificial Sequence
  synthetic [barcode part1]
cgattctggccttctt

SEQ ID NO: 34329 - DNA, 16 bp, Artificial Sequence
  synthetic [barcode part1]
aggaagaacacacgtg

SEQ ID NO: 34330 - DNA, 16 bp, Artificial Sequence
  synthetic [barcode part1]
tgtcttaagacttgcc

SEQ ID NO: 34331 - DNA, 16 bp, Artificial Sequence
  synthetic [barcode part1]
cgtacggcctaattcc

SEQ ID NO: 34332 - DNA, 16 bp, Artificial Sequence
  synthetic [barcode part1]
tgtgtacaccacaacg

SEQ ID NO: 34333 - DNA, 16 bp, Artificial Sequence
  synthetic [barcode part1]
gagacctggacgaact

SEQ ID NO: 34334 - DNA, 16 bp, Artificial Sequence
  synthetic [barcode part1]
gtagtctcttgtactg

SEQ ID NO: 34335 - DNA, 16 bp, Artificial Sequence
  synthetic [barcode part1]
aacgtacgaggtcgac

SEQ ID NO: 34336 - DNA, 16 bp, Artificial Sequence
  synthetic [barcode part1]
ataattgtggcgcgtc

SEQ ID NO: 34337 - DNA, 16 bp, Artificial Sequence
  synthetic [barcode part1]
cgccgtcttacgtaac

SEQ ID NO: 34338 - DNA, 16 bp, Artificial Sequence
  synthetic [barcode part1]
tagaggcgtaatctag

SEQ ID NO: 34339 - DNA, 16 bp, Artificial Sequence
  synthetic [barcode part1]
tggccgaatcaatcac

SEQ ID NO: 34340 - DNA, 16 bp, Artificial Sequence
  synthetic [barcode part1]
atccacaacgtctgag

SEQ ID NO: 34341 - DNA, 16 bp, Artificial Sequence
  synthetic [barcode part1]
cgtcgtccagacttgt

SEQ ID NO: 34342 - DNA, 16 bp, Artificial Sequence
  synthetic [barcode part1]
cgaaccaatcgaacct

SEQ ID NO: 34343 - DNA, 16 bp, Artificial Sequence
  synthetic [barcode part1]
cgtaacaggtgagtgc

SEQ ID NO: 34344 - DNA, 16 bp, Artificial Sequence
  synthetic [barcode part1]
ccgtcgttgaatactt

SEQ ID NO: 34345 - DNA, 16 bp, Artificial Sequence
  synthetic [barcode part1]
cgtacttcaaggacgt

SEQ ID NO: 34346 - DNA, 16 bp, Artificial Sequence
  synthetic [barcode part1]
tgcgtattaaccggtg

SEQ ID NO: 34347 - DNA, 16 bp, Artificial Sequence
  synthetic [barcode part1]
ttgccgttgttgtctc

SEQ ID NO: 34348 - DNA, 16 bp, Artificial Sequence
  synthetic [barcode part1]
atcgtgactatccgcc

SEQ ID NO: 34349 - DNA, 16 bp, Artificial Sequence
  synthetic [barcode part1]
agaatagttgcgagtc

SEQ ID NO: 34350 - DNA, 16 bp, Artificial Sequence
  synthetic [barcode part1]
cctaactccgattcct

SEQ ID NO: 34351 - DNA, 16 bp, Artificial Sequence
  synthetic [barcode part1]
gacgcgtgagatcaac

SEQ ID NO: 34352 - DNA, 16 bp, Artificial Sequence
  synthetic [barcode part1]
tgcacaagatagtgac

SEQ ID NO: 34353 - DNA, 16 bp, Artificial Sequence
  synthetic [barcode part1]
aatcgactaacgtcgc

SEQ ID NO: 34354 - DNA, 16 bp, Artificial Sequence
  synthetic [barcode part1]
taagtaccgcgttggt

SEQ ID NO: 34355 - DNA, 16 bp, Artificial Sequence
  synthetic [barcode part1]
gtcggtagagtacctt

SEQ ID NO: 34356 - DNA, 16 bp, Artificial Sequence
  synthetic [barcode part1]
agtacgttggtcacac

SEQ ID NO: 34357 - DNA, 16 bp, Artificial Sequence
  synthetic [barcode part1]
ttcgttgcgatcctct

SEQ ID NO: 34358 - DNA, 16 bp, Artificial Sequence
  synthetic [barcode part1]
agattcctctcctctg

SEQ ID NO: 34359 - DNA, 16 bp, Artificial Sequence
  synthetic [barcode part1]
cacttcacgaatacct

SEQ ID NO: 34360 - DNA, 16 bp, Artificial Sequence
  synthetic [barcode part1]
accgtggtagaatctc

SEQ ID NO: 34361 - DNA, 16 bp, Artificial Sequence
  synthetic [barcode part1]
gtacctcaccaagtcc

SEQ ID NO: 34362 - DNA, 16 bp, Artificial Sequence
  synthetic [barcode part1]
cgacttcgattcttcc

SEQ ID NO: 34363 - DNA, 16 bp, Artificial Sequence
  synthetic [barcode part1]
gtcgcctacttatagt

SEQ ID NO: 34364 - DNA, 16 bp, Artificial Sequence
  synthetic [barcode part1]
agtgatacgcctggag

SEQ ID NO: 34365 - DNA, 16 bp, Artificial Sequence
  synthetic [barcode part1]
cagactgttctacgtt

SEQ ID NO: 34366 - DNA, 16 bp, Artificial Sequence
  synthetic [barcode part1]
ttatacagaccgagag

SEQ ID NO: 34367 - DNA, 16 bp, Artificial Sequence
  synthetic [barcode part1]
cgccgttaacacacct

SEQ ID NO: 34368 - DNA, 16 bp, Artificial Sequence
  synthetic [barcode part1]
gttccaagtcacagtg

SEQ ID NO: 34369 - DNA, 16 bp, Artificial Sequence
  synthetic [barcode part1]
gtcttgccggacttac

SEQ ID NO: 34370 - DNA, 16 bp, Artificial Sequence
  synthetic [barcode part1]
tgaactgaagatacgc

SEQ ID NO: 34371 - DNA, 16 bp, Artificial Sequence
  synthetic [barcode part1]
tggtctctaactgcgc

SEQ ID NO: 34372 - DNA, 16 bp, Artificial Sequence
  synthetic [barcode part1]
tgcggtggataagtgc

SEQ ID NO: 34373 - DNA, 16 bp, Artificial Sequence
  synthetic [barcode part1]
atcacgtgatccgtag

SEQ ID NO: 34374 - DNA, 16 bp, Artificial Sequence
  synthetic [barcode part1]
aagatccgacggacac

SEQ ID NO: 34375 - DNA, 16 bp, Artificial Sequence
  synthetic [barcode part1]
acagtacgtgtacacc

SEQ ID NO: 34376 - DNA, 16 bp, Artificial Sequence
  synthetic [barcode part1]
tattccgaggttcact

SEQ ID NO: 34377 - DNA, 16 bp, Artificial Sequence
  synthetic [barcode part1]
tgtcgttccgcacagt

SEQ ID NO: 34378 - DNA, 16 bp, Artificial Sequence
  synthetic [barcode part1]
tacctgcgcaagtaac

SEQ ID NO: 34379 - DNA, 16 bp, Artificial Sequence
  synthetic [barcode part1]
aacgaggtataccaac

SEQ ID NO: 34380 - DNA, 16 bp, Artificial Sequence
  synthetic [barcode part1]
aataacgccgtctcag

SEQ ID NO: 34381 - DNA, 16 bp, Artificial Sequence
  synthetic [barcode part1]
tacggcggagtagatc

SEQ ID NO: 34382 - DNA, 16 bp, Artificial Sequence
  synthetic [barcode part1]
cactgatcgtgactag

SEQ ID NO: 34383 - DNA, 16 bp, Artificial Sequence
  synthetic [barcode part1]
agtcacgatacaccgt

SEQ ID NO: 34384 - DNA, 16 bp, Artificial Sequence
  synthetic [barcode part1]
gtaattacctctcgac

SEQ ID NO: 34385 - DNA, 16 bp, Artificial Sequence
  synthetic [barcode part1]
tctattgtggcctctc

SEQ ID NO: 34386 - DNA, 16 bp, Artificial Sequence
  synthetic [barcode part1]
tgtggcgttcagaatc

SEQ ID NO: 34387 - DNA, 16 bp, Artificial Sequence
  synthetic [barcode part1]
ttcactagacctgtac

SEQ ID NO: 34388 - DNA, 16 bp, Artificial Sequence
  synthetic [barcode part1]
gccagactatctccac

SEQ ID NO: 34389 - DNA, 16 bp, Artificial Sequence
  synthetic [barcode part1]
ccacaagtgagagatt

SEQ ID NO: 34390 - DNA, 16 bp, Artificial Sequence
  synthetic [barcode part1]
aacctaccactgtccg

SEQ ID NO: 34391 - DNA, 16 bp, Artificial Sequence
  synthetic [barcode part1]
tcctcttatcgtgacc

SEQ ID NO: 34392 - DNA, 16 bp, Artificial Sequence
  synthetic [barcode part1]
tagactgttggactgc

SEQ ID NO: 34393 - DNA, 16 bp, Artificial Sequence
  synthetic [barcode part1]
tggtcgatcagagtct

SEQ ID NO: 34394 - DNA, 16 bp, Artificial Sequence
  synthetic [barcode part1]
acgtaacaggagattc

SEQ ID NO: 34395 - DNA, 16 bp, Artificial Sequence
  synthetic [barcode part1]
aggtgacacgtctgag

SEQ ID NO: 34396 - DNA, 16 bp, Artificial Sequence
  synthetic [barcode part1]
gtaggactccaggtag

SEQ ID NO: 34397 - DNA, 16 bp, Artificial Sequence
  synthetic [barcode part1]
ttcgcacaatcgtcgc

SEQ ID NO: 34398 - DNA, 16 bp, Artificial Sequence
  synthetic [barcode part1]
ataggccggttacgtt

SEQ ID NO: 34399 - DNA, 16 bp, Artificial Sequence
  synthetic [barcode part1]
acttgagttgttctgc

SEQ ID NO: 34400 - DNA, 16 bp, Artificial Sequence
  synthetic [barcode part1]
gcacagtagtcggagt

SEQ ID NO: 34401 - DNA, 16 bp, Artificial Sequence
  synthetic [barcode part1]
tcgtctcctaacgcag

SEQ ID NO: 34402 - DNA, 16 bp, Artificial Sequence
  synthetic [barcode part1]
gacttagaggaacgcc

SEQ ID NO: 34403 - DNA, 16 bp, Artificial Sequence
  synthetic [barcode part1]
tacgatcggagtgacg

SEQ ID NO: 34404 - DNA, 16 bp, Artificial Sequence
  synthetic [barcode part1]
acgagtcgtacgactt

SEQ ID NO: 34405 - DNA, 16 bp, Artificial Sequence
  synthetic [barcode part1]
tgtcagtcctcggttg

SEQ ID NO: 34406 - DNA, 16 bp, Artificial Sequence
  synthetic [barcode part1]
gcggtggaacaataag

SEQ ID NO: 34407 - DNA, 16 bp, Artificial Sequence
  synthetic [barcode part1]
aggttgtgtccaacac

SEQ ID NO: 34408 - DNA, 16 bp, Artificial Sequence
  synthetic [barcode part1]
accgccttctagacgt

SEQ ID NO: 34409 - DNA, 16 bp, Artificial Sequence
  synthetic [barcode part1]
aagtgtagattcggtg

SEQ ID NO: 34410 - DNA, 16 bp, Artificial Sequence
  synthetic [barcode part1]
gcgttatcttgaggtg

SEQ ID NO: 34411 - DNA, 16 bp, Artificial Sequence
  synthetic [barcode part1]
gcacggtagagaatcc

SEQ ID NO: 34412 - DNA, 16 bp, Artificial Sequence
  synthetic [barcode part1]
tctaaccactgacact

SEQ ID NO: 34413 - DNA, 16 bp, Artificial Sequence
  synthetic [barcode part1]
atccaggtcgtctcgt

SEQ ID NO: 34414 - DNA, 16 bp, Artificial Sequence
  synthetic [barcode part1]
atataaccttcggtcc

SEQ ID NO: 34415 - DNA, 16 bp, Artificial Sequence
  synthetic [barcode part1]
tataactccgaacgcg

SEQ ID NO: 34416 - DNA, 16 bp, Artificial Sequence
  synthetic [barcode part1]
tggcgaatctactacg

SEQ ID NO: 34417 - DNA, 16 bp, Artificial Sequence
  synthetic [barcode part1]
agtcctcgacttatac

SEQ ID NO: 34418 - DNA, 16 bp, Artificial Sequence
  synthetic [barcode part1]
gccggcactcaattct

SEQ ID NO: 34419 - DNA, 16 bp, Artificial Sequence
  synthetic [barcode part1]
aatcggttaactggcc

SEQ ID NO: 34420 - DNA, 16 bp, Artificial Sequence
  synthetic [barcode part1]
tagatatcgcggatcc

SEQ ID NO: 34421 - DNA, 16 bp, Artificial Sequence
  synthetic [barcode part1]
ccgatccaagtcaagt

SEQ ID NO: 34422 - DNA, 16 bp, Artificial Sequence
  synthetic [barcode part1]
accttcagtgattcgt

SEQ ID NO: 34423 - DNA, 16 bp, Artificial Sequence
  synthetic [barcode part1]
tcctcctataccgtgt

SEQ ID NO: 34424 - DNA, 16 bp, Artificial Sequence
  synthetic [barcode part1]
gacctgacaacgatct

SEQ ID NO: 34425 - DNA, 16 bp, Artificial Sequence
  synthetic [barcode part1]
acggacaattcgtctg

SEQ ID NO: 34426 - DNA, 16 bp, Artificial Sequence
  synthetic [barcode part1]
cggccaggattaactt

SEQ ID NO: 34427 - DNA, 16 bp, Artificial Sequence
  synthetic [barcode part1]
acggcaattcaactcg

SEQ ID NO: 34428 - DNA, 16 bp, Artificial Sequence
  synthetic [barcode part1]
tcttccggacagtaag

SEQ ID NO: 34429 - DNA, 16 bp, Artificial Sequence
  synthetic [barcode part1]
gaatccacttgacttc

SEQ ID NO: 34430 - DNA, 16 bp, Artificial Sequence
  synthetic [barcode part1]
agtcaaccacaacgtc

SEQ ID NO: 34431 - DNA, 16 bp, Artificial Sequence
  synthetic [barcode part1]
taacaaggaacctgtg

SEQ ID NO: 34432 - DNA, 16 bp, Artificial Sequence
  synthetic [barcode part1]
acttgacgtgttcttg

SEQ ID NO: 34433 - DNA, 16 bp, Artificial Sequence
  synthetic [barcode part1]
acgccgatcctactac

SEQ ID NO: 34434 - DNA, 16 bp, Artificial Sequence
  synthetic [barcode part1]
gactcctctaagtatc

SEQ ID NO: 34435 - DNA, 16 bp, Artificial Sequence
  synthetic [barcode part1]
gcgagagactatcggt

SEQ ID NO: 34436 - DNA, 16 bp, Artificial Sequence
  synthetic [barcode part1]
taacgcaaggacggtc

SEQ ID NO: 34437 - DNA, 16 bp, Artificial Sequence
  synthetic [barcode part1]
attcttccgacgcacg

SEQ ID NO: 34438 - DNA, 16 bp, Artificial Sequence
  synthetic [barcode part1]
caagactcgtagtgtc

SEQ ID NO: 34439 - DNA, 16 bp, Artificial Sequence
  synthetic [barcode part1]
tctctcgaatacgttg

SEQ ID NO: 34440 - DNA, 16 bp, Artificial Sequence
  synthetic [barcode part1]
attccacgcctggact

SEQ ID NO: 34441 - DNA, 16 bp, Artificial Sequence
  synthetic [barcode part1]
ttccgtaactggactt

SEQ ID NO: 34442 - DNA, 16 bp, Artificial Sequence
  synthetic [barcode part1]
acaccgacttctagtt

SEQ ID NO: 34443 - DNA, 16 bp, Artificial Sequence
  synthetic [barcode part1]
gtccttgagtacgaac

SEQ ID NO: 34444 - DNA, 16 bp, Artificial Sequence
  synthetic [barcode part1]
cgttgttcaagttcgt

SEQ ID NO: 34445 - DNA, 16 bp, Artificial Sequence
  synthetic [barcode part1]
taacttcggaatcggc

SEQ ID NO: 34446 - DNA, 16 bp, Artificial Sequence
  synthetic [barcode part1]
tcggtcgaactgattg

SEQ ID NO: 34447 - DNA, 16 bp, Artificial Sequence
  synthetic [barcode part1]
tacctagattactccg

SEQ ID NO: 34448 - DNA, 16 bp, Artificial Sequence
  synthetic [barcode part1]
cgagaggtgacgtgtt

SEQ ID NO: 34449 - DNA, 16 bp, Artificial Sequence
  synthetic [barcode part1]
gtagatcgaggtgacc

SEQ ID NO: 34450 - DNA, 16 bp, Artificial Sequence
  synthetic [barcode part1]
tcgcctgcaagtaagt

SEQ ID NO: 34451 - DNA, 16 bp, Artificial Sequence
  synthetic [barcode part1]
taccaggcacttccgt

SEQ ID NO: 34452 - DNA, 16 bp, Artificial Sequence
  synthetic [barcode part1]
gcggaccaggataact

SEQ ID NO: 34453 - DNA, 16 bp, Artificial Sequence
  synthetic [barcode part1]
tagattggcgtctctt

SEQ ID NO: 34454 - DNA, 16 bp, Artificial Sequence
  synthetic [barcode part1]
ccgactcaacacgtct

SEQ ID NO: 34455 - DNA, 16 bp, Artificial Sequence
  synthetic [barcode part1]
ccactctacgcaactg

SEQ ID NO: 34456 - DNA, 16 bp, Artificial Sequence
  synthetic [barcode part1]
tgtctgcggtatcgtc

SEQ ID NO: 34457 - DNA, 16 bp, Artificial Sequence
  synthetic [barcode part1]
ccgttgtagacttgcc

SEQ ID NO: 34458 - DNA, 16 bp, Artificial Sequence
  synthetic [barcode part1]
gttacgactattcgtc

SEQ ID NO: 34459 - DNA, 16 bp, Artificial Sequence
  synthetic [barcode part1]
aaggagaaggagagag

SEQ ID NO: 34460 - DNA, 16 bp, Artificial Sequence
  synthetic [barcode part1]
accttagtcggaactg

SEQ ID NO: 34461 - DNA, 16 bp, Artificial Sequence
  synthetic [barcode part1]
accgtgactcgtctgt

SEQ ID NO: 34462 - DNA, 16 bp, Artificial Sequence
  synthetic [barcode part1]
tgttggtggccttctg

SEQ ID NO: 34463 - DNA, 16 bp, Artificial Sequence
  synthetic [barcode part1]
gcgtgtctctgatctg

SEQ ID NO: 34464 - DNA, 16 bp, Artificial Sequence
  synthetic [barcode part1]
gcgagtagtaagtgag

SEQ ID NO: 34465 - DNA, 16 bp, Artificial Sequence
  synthetic [barcode part1]
acgcctcgacttggtt

SEQ ID NO: 34466 - DNA, 16 bp, Artificial Sequence
  synthetic [barcode part1]
gcactcttagtccgac

SEQ ID NO: 34467 - DNA, 16 bp, Artificial Sequence
  synthetic [barcode part1]
tggtgactcttgtact

SEQ ID NO: 34468 - DNA, 16 bp, Artificial Sequence
  synthetic [barcode part1]
gcaagagtgatagttc

SEQ ID NO: 34469 - DNA, 16 bp, Artificial Sequence
  synthetic [barcode part1]
gcgtctgagtagagtg

SEQ ID NO: 34470 - DNA, 16 bp, Artificial Sequence
  synthetic [barcode part1]
gttcgtatacgagtcg

SEQ ID NO: 34471 - DNA, 16 bp, Artificial Sequence
  synthetic [barcode part1]
gatatcctctggtccg

SEQ ID NO: 34472 - DNA, 16 bp, Artificial Sequence
  synthetic [barcode part1]
aattacaggtcaaggc

SEQ ID NO: 34473 - DNA, 16 bp, Artificial Sequence
  synthetic [barcode part1]
gcagtacacacacgtt

SEQ ID NO: 34474 - DNA, 16 bp, Artificial Sequence
  synthetic [barcode part1]
cgattactggacctag

SEQ ID NO: 34475 - DNA, 16 bp, Artificial Sequence
  synthetic [barcode part1]
actaacgaacgcgttc

SEQ ID NO: 34476 - DNA, 16 bp, Artificial Sequence
  synthetic [barcode part1]
gacaggaccttgttac

SEQ ID NO: 34477 - DNA, 16 bp, Artificial Sequence
  synthetic [barcode part1]
aactggtaattccggc

SEQ ID NO: 34478 - DNA, 16 bp, Artificial Sequence
  synthetic [barcode part1]
tcctgcgatacttcct

SEQ ID NO: 34479 - DNA, 16 bp, Artificial Sequence
  synthetic [barcode part1]
cacggacaggcaatac

SEQ ID NO: 34480 - DNA, 16 bp, Artificial Sequence
  synthetic [barcode part1]
aacggcagttctgttg

SEQ ID NO: 34481 - DNA, 16 bp, Artificial Sequence
  synthetic [barcode part1]
atcctaggtgtcacag

SEQ ID NO: 34482 - DNA, 16 bp, Artificial Sequence
  synthetic [barcode part1]
cagacttcagacgttg

SEQ ID NO: 34483 - DNA, 16 bp, Artificial Sequence
  synthetic [barcode part1]
actgtggcctacctgt

SEQ ID NO: 34484 - DNA, 16 bp, Artificial Sequence
  synthetic [barcode part1]
tctacgaagacctgtg

SEQ ID NO: 34485 - DNA, 16 bp, Artificial Sequence
  synthetic [barcode part1]
caatcttatcgcgtac

SEQ ID NO: 34486 - DNA, 16 bp, Artificial Sequence
  synthetic [barcode part1]
ttggtaactcacacct

SEQ ID NO: 34487 - DNA, 16 bp, Artificial Sequence
  synthetic [barcode part1]
cactactagtggcagt

SEQ ID NO: 34488 - DNA, 16 bp, Artificial Sequence
  synthetic [barcode part1]
cagattcacagtgaag

SEQ ID NO: 34489 - DNA, 16 bp, Artificial Sequence
  synthetic [barcode part1]
caggaagaacttcctc

SEQ ID NO: 34490 - DNA, 16 bp, Artificial Sequence
  synthetic [barcode part1]
acaaggacacgagagt

SEQ ID NO: 34491 - DNA, 16 bp, Artificial Sequence
  synthetic [barcode part1]
acgcacagtactacgt

SEQ ID NO: 34492 - DNA, 16 bp, Artificial Sequence
  synthetic [barcode part1]
gttatctgtaggttcc

SEQ ID NO: 34493 - DNA, 16 bp, Artificial Sequence
  synthetic [barcode part1]
cctgaggcacaatatc

SEQ ID NO: 34494 - DNA, 16 bp, Artificial Sequence
  synthetic [barcode part1]
acctctcttcctcaag

SEQ ID NO: 34495 - DNA, 16 bp, Artificial Sequence
  synthetic [barcode part1]
ttatcgtcgcctggac

SEQ ID NO: 34496 - DNA, 16 bp, Artificial Sequence
  synthetic [barcode part1]
cctgttggtgttcgac

SEQ ID NO: 34497 - DNA, 16 bp, Artificial Sequence
  synthetic [barcode part1]
cacgagaattgtcaag

SEQ ID NO: 34498 - DNA, 16 bp, Artificial Sequence
  synthetic [barcode part1]
acttggactcgttatc

SEQ ID NO: 34499 - DNA, 16 bp, Artificial Sequence
  synthetic [barcode part1]
cctcgttaggcaatag

SEQ ID NO: 34500 - DNA, 16 bp, Artificial Sequence
  synthetic [barcode part1]
actacgagtgaacaac

SEQ ID NO: 34501 - DNA, 16 bp, Artificial Sequence
  synthetic [barcode part1]
cactaccaagttaggc

SEQ ID NO: 34502 - DNA, 16 bp, Artificial Sequence
  synthetic [barcode part1]
atcttaccgaacctac

SEQ ID NO: 34503 - DNA, 16 bp, Artificial Sequence
  synthetic [barcode part1]
tatccgcctacagtgc

SEQ ID NO: 34504 - DNA, 16 bp, Artificial Sequence
  synthetic [barcode part1]
ttgcaacacgtgtgtg

SEQ ID NO: 34505 - DNA, 16 bp, Artificial Sequence
  synthetic [barcode part1]
ccgaataggtagaatc

SEQ ID NO: 34506 - DNA, 16 bp, Artificial Sequence
  synthetic [barcode part1]
aggactgcgcgttaag

SEQ ID NO: 34507 - DNA, 16 bp, Artificial Sequence
  synthetic [barcode part1]
gcacgaacaagtcacg

SEQ ID NO: 34508 - DNA, 16 bp, Artificial Sequence
  synthetic [barcode part1]
gtggattgattcacgc

SEQ ID NO: 34509 - DNA, 16 bp, Artificial Sequence
  synthetic [barcode part1]
tattgtctcgtgcggc

SEQ ID NO: 34510 - DNA, 16 bp, Artificial Sequence
  synthetic [barcode part1]
cgccttgcaggtactt

SEQ ID NO: 34511 - DNA, 16 bp, Artificial Sequence
  synthetic [barcode part1]
tgtgacaggtagatac

SEQ ID NO: 34512 - DNA, 16 bp, Artificial Sequence
  synthetic [barcode part1]
gaatctggtcttctac

SEQ ID NO: 34513 - DNA, 16 bp, Artificial Sequence
  synthetic [barcode part1]
gactcctggtcgtatc

SEQ ID NO: 34514 - DNA, 16 bp, Artificial Sequence
  synthetic [barcode part1]
gaagaataagtgcctc

SEQ ID NO: 34515 - DNA, 16 bp, Artificial Sequence
  synthetic [barcode part1]
actctcacggattact

SEQ ID NO: 34516 - DNA, 16 bp, Artificial Sequence
  synthetic [barcode part1]
ttatcaatctccgcag

SEQ ID NO: 34517 - DNA, 16 bp, Artificial Sequence
  synthetic [barcode part1]
tcgatactgatcgcag

SEQ ID NO: 34518 - DNA, 16 bp, Artificial Sequence
  synthetic [barcode part1]
agacaagacgatacct

SEQ ID NO: 34519 - DNA, 16 bp, Artificial Sequence
  synthetic [barcode part1]
cacgaaggattactag

SEQ ID NO: 34520 - DNA, 16 bp, Artificial Sequence
  synthetic [barcode part1]
gcgtgtgtatagtacc

SEQ ID NO: 34521 - DNA, 16 bp, Artificial Sequence
  synthetic [barcode part1]
tcgtaaccacgtacag

SEQ ID NO: 34522 - DNA, 16 bp, Artificial Sequence
  synthetic [barcode part1]
cgcgttcacaagaact

SEQ ID NO: 34523 - DNA, 16 bp, Artificial Sequence
  synthetic [barcode part1]
atacgtgaggaaggac

SEQ ID NO: 34524 - DNA, 16 bp, Artificial Sequence
  synthetic [barcode part1]
tctgcactgtaggaac

SEQ ID NO: 34525 - DNA, 16 bp, Artificial Sequence
  synthetic [barcode part1]
tcagagtacttactcc

SEQ ID NO: 34526 - DNA, 16 bp, Artificial Sequence
  synthetic [barcode part1]
tgttctacgaacactc

SEQ ID NO: 34527 - DNA, 16 bp, Artificial Sequence
  synthetic [barcode part1]
gaacagaccacggtgt

SEQ ID NO: 34528 - DNA, 16 bp, Artificial Sequence
  synthetic [barcode part1]
acagttcttcgtactg

SEQ ID NO: 34529 - DNA, 16 bp, Artificial Sequence
  synthetic [barcode part1]
gtagacgtctgaggtg

SEQ ID NO: 34530 - DNA, 16 bp, Artificial Sequence
  synthetic [barcode part1]
cgtacggtccaacttc

SEQ ID NO: 34531 - DNA, 16 bp, Artificial Sequence
  synthetic [barcode part1]
cgttccaagatctatc

SEQ ID NO: 34532 - DNA, 16 bp, Artificial Sequence
  synthetic [barcode part1]
tacacaatcgttgcct

SEQ ID NO: 34533 - DNA, 16 bp, Artificial Sequence
  synthetic [barcode part1]
ttcacacaccactagt

SEQ ID NO: 34534 - DNA, 16 bp, Artificial Sequence
  synthetic [barcode part1]
tcttggttacggactt

SEQ ID NO: 34535 - DNA, 16 bp, Artificial Sequence
  synthetic [barcode part1]
gactgtaatacaccgc

SEQ ID NO: 34536 - DNA, 16 bp, Artificial Sequence
  synthetic [barcode part1]
agtacgcaacttcctt

SEQ ID NO: 34537 - DNA, 16 bp, Artificial Sequence
  synthetic [barcode part1]
gtgaccaacgtcagtt

SEQ ID NO: 34538 - DNA, 16 bp, Artificial Sequence
  synthetic [barcode part1]
agtgccgttaagactc

SEQ ID NO: 34539 - DNA, 16 bp, Artificial Sequence
  synthetic [barcode part1]
ccgttcaggattccac

SEQ ID NO: 34540 - DNA, 16 bp, Artificial Sequence
  synthetic [barcode part1]
tgccgtgttagttgag

SEQ ID NO: 34541 - DNA, 16 bp, Artificial Sequence
  synthetic [barcode part1]
tgcgttcgcagtctac

SEQ ID NO: 34542 - DNA, 16 bp, Artificial Sequence
  synthetic [barcode part1]
gtagatactgtgacag

SEQ ID NO: 34543 - DNA, 16 bp, Artificial Sequence
  synthetic [barcode part1]
ccgaacctaatccaag

SEQ ID NO: 34544 - DNA, 16 bp, Artificial Sequence
  synthetic [barcode part1]
gaggccgcgtattaag

SEQ ID NO: 34545 - DNA, 16 bp, Artificial Sequence
  synthetic [barcode part1]
ccgtatagtcaacacg

SEQ ID NO: 34546 - DNA, 16 bp, Artificial Sequence
  synthetic [barcode part1]
taggatcttggtcgac

SEQ ID NO: 34547 - DNA, 16 bp, Artificial Sequence
  synthetic [barcode part1]
tatcggtgcgtactag

SEQ ID NO: 34548 - DNA, 16 bp, Artificial Sequence
  synthetic [barcode part1]
gtgaggagtatccttc

SEQ ID NO: 34549 - DNA, 16 bp, Artificial Sequence
  synthetic [barcode part1]
cacactatccttcaag

SEQ ID NO: 34550 - DNA, 16 bp, Artificial Sequence
  synthetic [barcode part1]
taccaccacagttgcc

SEQ ID NO: 34551 - DNA, 16 bp, Artificial Sequence
  synthetic [barcode part1]
cgcgagtgaacttatc

SEQ ID NO: 34552 - DNA, 16 bp, Artificial Sequence
  synthetic [barcode part1]
caggactacactgtgt

SEQ ID NO: 34553 - DNA, 16 bp, Artificial Sequence
  synthetic [barcode part1]
cgacgtggtatagttc

SEQ ID NO: 34554 - DNA, 16 bp, Artificial Sequence
  synthetic [barcode part1]
tccttctcagtactgc

SEQ ID NO: 34555 - DNA, 16 bp, Artificial Sequence
  synthetic [barcode part1]
cagtagtaatcgccac

SEQ ID NO: 34556 - DNA, 16 bp, Artificial Sequence
  synthetic [barcode part1]
ccacacgttgaaggag

SEQ ID NO: 34557 - DNA, 16 bp, Artificial Sequence
  synthetic [barcode part1]
tgttacgcgtagtgtg

SEQ ID NO: 34558 - DNA, 16 bp, Artificial Sequence
  synthetic [barcode part1]
acacggaagtacagag

SEQ ID NO: 34559 - DNA, 16 bp, Artificial Sequence
  synthetic [barcode part1]
aacgactcctccgtac

SEQ ID NO: 34560 - DNA, 16 bp, Artificial Sequence
  synthetic [barcode part1]
gagtcgaatcgtgcag

SEQ ID NO: 34561 - DNA, 16 bp, Artificial Sequence
  synthetic [barcode part1]
tataatccggtcttcg

SEQ ID NO: 34562 - DNA, 16 bp, Artificial Sequence
  synthetic [barcode part1]
ttagaaggcgtgattg

SEQ ID NO: 34563 - DNA, 16 bp, Artificial Sequence
  synthetic [barcode part1]
acaacgtactgtggtc

SEQ ID NO: 34564 - DNA, 16 bp, Artificial Sequence
  synthetic [barcode part1]
gtactaacgactcctt

SEQ ID NO: 34565 - DNA, 16 bp, Artificial Sequence
  synthetic [barcode part1]
gtacttgtctgtcgcg

SEQ ID NO: 34566 - DNA, 16 bp, Artificial Sequence
  synthetic [barcode part1]
ccgtaagaccttccgt

SEQ ID NO: 34567 - DNA, 16 bp, Artificial Sequence
  synthetic [barcode part1]
attccgtcctgcaggt

SEQ ID NO: 34568 - DNA, 16 bp, Artificial Sequence
  synthetic [barcode part1]
gtctcaacggtgttag

SEQ ID NO: 34569 - DNA, 16 bp, Artificial Sequence
  synthetic [barcode part1]
ttactctaccgttccg

SEQ ID NO: 34570 - DNA, 16 bp, Artificial Sequence
  synthetic [barcode part1]
agttaatcagtcggcc

SEQ ID NO: 34571 - DNA, 16 bp, Artificial Sequence
  synthetic [barcode part1]
tgattgcggtgtgttg

SEQ ID NO: 34572 - DNA, 16 bp, Artificial Sequence
  synthetic [barcode part1]
gcgtcgaatcgagaac

SEQ ID NO: 34573 - DNA, 16 bp, Artificial Sequence
  synthetic [barcode part1]
tgcgttcctgtcgaac

SEQ ID NO: 34574 - DNA, 16 bp, Artificial Sequence
  synthetic [barcode part1]
taggcgtcaatagagt

SEQ ID NO: 34575 - DNA, 16 bp, Artificial Sequence
  synthetic [barcode part1]
gaatacaccgacggtg

SEQ ID NO: 34576 - DNA, 16 bp, Artificial Sequence
  synthetic [barcode part1]
ccaacgaagtgcaggt

SEQ ID NO: 34577 - DNA, 16 bp, Artificial Sequence
  synthetic [barcode part1]
gattgcgttgatcctt

SEQ ID NO: 34578 - DNA, 16 bp, Artificial Sequence
  synthetic [barcode part1]
gtcttacaacgcactt

SEQ ID NO: 34579 - DNA, 16 bp, Artificial Sequence
  synthetic [barcode part1]
gtgtaatcaaccgcgt

SEQ ID NO: 34580 - DNA, 16 bp, Artificial Sequence
  synthetic [barcode part1]
aacggccgttgttaac

SEQ ID NO: 34581 - DNA, 16 bp, Artificial Sequence
  synthetic [barcode part1]
aactaacgtcggtcgt

SEQ ID NO: 34582 - DNA, 16 bp, Artificial Sequence
  synthetic [barcode part1]
tgtgaacctcggatac

SEQ ID NO: 34583 - DNA, 16 bp, Artificial Sequence
  synthetic [barcode part1]
acagtcacctcaattc

SEQ ID NO: 34584 - DNA, 16 bp, Artificial Sequence
  synthetic [barcode part1]
gacactggtgtacgtt

SEQ ID NO: 34585 - DNA, 16 bp, Artificial Sequence
  synthetic [barcode part1]
tccttctgactctgac

SEQ ID NO: 34586 - DNA, 16 bp, Artificial Sequence
  synthetic [barcode part1]
tgaaggacaatcgtgt

SEQ ID NO: 34587 - DNA, 16 bp, Artificial Sequence
  synthetic [barcode part1]
aagtcactgtcgaacc

SEQ ID NO: 34588 - DNA, 16 bp, Artificial Sequence
  synthetic [barcode part1]
agttcggaggacgtgt

SEQ ID NO: 34589 - DNA, 16 bp, Artificial Sequence
  synthetic [barcode part1]
cacgccttctagtggt

SEQ ID NO: 34590 - DNA, 16 bp, Artificial Sequence
  synthetic [barcode part1]
ccttacaagaggcgtt

SEQ ID NO: 34591 - DNA, 16 bp, Artificial Sequence
  synthetic [barcode part1]
ttcgaccttagaaggc

SEQ ID NO: 34592 - DNA, 16 bp, Artificial Sequence
  synthetic [barcode part1]
aagtctatcgcacggt

SEQ ID NO: 34593 - DNA, 16 bp, Artificial Sequence
  synthetic [barcode part1]
cggtagactacaggtg

SEQ ID NO: 34594 - DNA, 16 bp, Artificial Sequence
  synthetic [barcode part1]
tgacctcacgttgacc

SEQ ID NO: 34595 - DNA, 16 bp, Artificial Sequence
  synthetic [barcode part1]
caatcgtgatacgtcg

SEQ ID NO: 34596 - DNA, 16 bp, Artificial Sequence
  synthetic [barcode part1]
tgaggttatcgcagtc

SEQ ID NO: 34597 - DNA, 16 bp, Artificial Sequence
  synthetic [barcode part1]
gatatcgcaacaccac

SEQ ID NO: 34598 - DNA, 16 bp, Artificial Sequence
  synthetic [barcode part1]
gagaataagaccgttc

SEQ ID NO: 34599 - DNA, 16 bp, Artificial Sequence
  synthetic [barcode part1]
tccagttctggtctct

SEQ ID NO: 34600 - DNA, 16 bp, Artificial Sequence
  synthetic [barcode part1]
aggtcgcgagtacaac

SEQ ID NO: 34601 - DNA, 16 bp, Artificial Sequence
  synthetic [barcode part1]
taacgactcaagtcgc

SEQ ID NO: 34602 - DNA, 16 bp, Artificial Sequence
  synthetic [barcode part1]
actccgcaagtattct

SEQ ID NO: 34603 - DNA, 16 bp, Artificial Sequence
  synthetic [barcode part1]
tggtgcgtaacggaac

SEQ ID NO: 34604 - DNA, 16 bp, Artificial Sequence
  synthetic [barcode part1]
taattccgccaatacc

SEQ ID NO: 34605 - DNA, 16 bp, Artificial Sequence
  synthetic [barcode part1]
gttaggcctcagtagt

SEQ ID NO: 34606 - DNA, 16 bp, Artificial Sequence
  synthetic [barcode part1]
tcgaggataacttccg

SEQ ID NO: 34607 - DNA, 16 bp, Artificial Sequence
  synthetic [barcode part1]
tctgaccgttaacgcc

SEQ ID NO: 34608 - DNA, 16 bp, Artificial Sequence
  synthetic [barcode part1]
gttgttgttctgtacg

SEQ ID NO: 34609 - DNA, 16 bp, Artificial Sequence
  synthetic [barcode part1]
tagaccggacctagtt

SEQ ID NO: 34610 - DNA, 16 bp, Artificial Sequence
  synthetic [barcode part1]
taggtaccaacgaggc

SEQ ID NO: 34611 - DNA, 16 bp, Artificial Sequence
  synthetic [barcode part1]
gcgtagacgttagacg

SEQ ID NO: 34612 - DNA, 16 bp, Artificial Sequence
  synthetic [barcode part1]
agagaccgattgagag

SEQ ID NO: 34613 - DNA, 16 bp, Artificial Sequence
  synthetic [barcode part1]
cgtgacgtaagacttc

SEQ ID NO: 34614 - DNA, 16 bp, Artificial Sequence
  synthetic [barcode part1]
aaggcgagacgttcac

SEQ ID NO: 34615 - DNA, 16 bp, Artificial Sequence
  synthetic [barcode part1]
gagtgacaattcgtag

SEQ ID NO: 34616 - DNA, 16 bp, Artificial Sequence
  synthetic [barcode part1]
ttccggcagtcacact

SEQ ID NO: 34617 - DNA, 16 bp, Artificial Sequence
  synthetic [barcode part1]
ttctcggtacagtcgc

SEQ ID NO: 34618 - DNA, 16 bp, Artificial Sequence
  synthetic [barcode part1]
atattgattccgccac

SEQ ID NO: 34619 - DNA, 16 bp, Artificial Sequence
  synthetic [barcode part1]
gaaggtggtctaatac

SEQ ID NO: 34620 - DNA, 16 bp, Artificial Sequence
  synthetic [barcode part1]
taaggaatccttcggc

SEQ ID NO: 34621 - DNA, 16 bp, Artificial Sequence
  synthetic [barcode part1]
tgtacgttcgaccaag

SEQ ID NO: 34622 - DNA, 16 bp, Artificial Sequence
  synthetic [barcode part1]
gcgagaattctacgtc

SEQ ID NO: 34623 - DNA, 16 bp, Artificial Sequence
  synthetic [barcode part1]
tacgtgagagtgtctc

SEQ ID NO: 34624 - DNA, 16 bp, Artificial Sequence
  synthetic [barcode part1]
ttgtgacactgaccag

SEQ ID NO: 34625 - DNA, 16 bp, Artificial Sequence
  synthetic [barcode part1]
caacgttgcagtactg

SEQ ID NO: 34626 - DNA, 16 bp, Artificial Sequence
  synthetic [barcode part1]
atctctgttcggcggt

SEQ ID NO: 34627 - DNA, 16 bp, Artificial Sequence
  synthetic [barcode part1]
cagtgacgaggtgtgt

SEQ ID NO: 34628 - DNA, 16 bp, Artificial Sequence
  synthetic [barcode part1]
ttcggtaacgacctag

SEQ ID NO: 34629 - DNA, 16 bp, Artificial Sequence
  synthetic [barcode part1]
atcgtacaaccacacg

SEQ ID NO: 34630 - DNA, 16 bp, Artificial Sequence
  synthetic [barcode part1]
gacctggaatcgttac

SEQ ID NO: 34631 - DNA, 16 bp, Artificial Sequence
  synthetic [barcode part1]
tccacacggttatcgc

SEQ ID NO: 34632 - DNA, 16 bp, Artificial Sequence
  synthetic [barcode part1]
atctgaagtctgcggt

SEQ ID NO: 34633 - DNA, 16 bp, Artificial Sequence
  synthetic [barcode part1]
tctggttcaacacgtt

SEQ ID NO: 34634 - DNA, 16 bp, Artificial Sequence
  synthetic [barcode part1]
ataggaactggattgc

SEQ ID NO: 34635 - DNA, 16 bp, Artificial Sequence
  synthetic [barcode part1]
atactgacgtaccggt

SEQ ID NO: 34636 - DNA, 16 bp, Artificial Sequence
  synthetic [barcode part1]
caattctaccacgcgc

SEQ ID NO: 34637 - DNA, 16 bp, Artificial Sequence
  synthetic [barcode part1]
gcaagttaaggcgacc

SEQ ID NO: 34638 - DNA, 16 bp, Artificial Sequence
  synthetic [barcode part1]
gcgtcggtagtaaggt

SEQ ID NO: 34639 - DNA, 16 bp, Artificial Sequence
  synthetic [barcode part1]
ataggatcgtctagag

SEQ ID NO: 34640 - DNA, 16 bp, Artificial Sequence
  synthetic [barcode part1]
accgttcttgccttac

SEQ ID NO: 34641 - DNA, 16 bp, Artificial Sequence
  synthetic [barcode part1]
cacgtattgtacgcag

SEQ ID NO: 34642 - DNA, 16 bp, Artificial Sequence
  synthetic [barcode part1]
atcgtgtgccgttctg

SEQ ID NO: 34643 - DNA, 16 bp, Artificial Sequence
  synthetic [barcode part1]
cggcaggtattacttg

SEQ ID NO: 34644 - DNA, 16 bp, Artificial Sequence
  synthetic [barcode part1]
gcaacaccacaacgtt

SEQ ID NO: 34645 - DNA, 16 bp, Artificial Sequence
  synthetic [barcode part1]
cagaagaggttggagt

SEQ ID NO: 34646 - DNA, 16 bp, Artificial Sequence
  synthetic [barcode part1]
atccgagtattgcctt

SEQ ID NO: 34647 - DNA, 16 bp, Artificial Sequence
  synthetic [barcode part1]
tactggaggatcgttc

SEQ ID NO: 34648 - DNA, 16 bp, Artificial Sequence
  synthetic [barcode part1]
tggccagattgtagtc

SEQ ID NO: 34649 - DNA, 16 bp, Artificial Sequence
  synthetic [barcode part1]
acgtggcaactccttc

SEQ ID NO: 34650 - DNA, 16 bp, Artificial Sequence
  synthetic [barcode part1]
gagtcgcctatacctc

SEQ ID NO: 34651 - DNA, 16 bp, Artificial Sequence
  synthetic [barcode part1]
tggtaatacacgaggt

SEQ ID NO: 34652 - DNA, 16 bp, Artificial Sequence
  synthetic [barcode part1]
gagtatactccacgtg

SEQ ID NO: 34653 - DNA, 16 bp, Artificial Sequence
  synthetic [barcode part1]
gagtggatacttgtcc

SEQ ID NO: 34654 - DNA, 16 bp, Artificial Sequence
  synthetic [barcode part1]
gttgcagacggtatct

SEQ ID NO: 34655 - DNA, 16 bp, Artificial Sequence
  synthetic [barcode part1]
ataccaccgtctgtcg

SEQ ID NO: 34656 - DNA, 16 bp, Artificial Sequence
  synthetic [barcode part1]
cagactgcctctgtgt

SEQ ID NO: 34657 - DNA, 16 bp, Artificial Sequence
  synthetic [barcode part1]
cgacaataatcaccgc

SEQ ID NO: 34658 - DNA, 16 bp, Artificial Sequence
  synthetic [barcode part1]
gaacttgtccacagac

SEQ ID NO: 34659 - DNA, 16 bp, Artificial Sequence
  synthetic [barcode part1]
gtgcgaacttagtaag

SEQ ID NO: 34660 - DNA, 16 bp, Artificial Sequence
  synthetic [barcode part1]
aactgcagtacgttgc

SEQ ID NO: 34661 - DNA, 16 bp, Artificial Sequence
  synthetic [barcode part1]
ccgtcgagtactcttg

SEQ ID NO: 34662 - DNA, 16 bp, Artificial Sequence
  synthetic [barcode part1]
tgtcaactggtcacag

SEQ ID NO: 34663 - DNA, 16 bp, Artificial Sequence
  synthetic [barcode part1]
acggtgagagtatccg

SEQ ID NO: 34664 - DNA, 16 bp, Artificial Sequence
  synthetic [barcode part1]
agtggcagtctacgag

SEQ ID NO: 34665 - DNA, 16 bp, Artificial Sequence
  synthetic [barcode part1]
actagacacgatccac

SEQ ID NO: 34666 - DNA, 16 bp, Artificial Sequence
  synthetic [barcode part1]
aacaccttcaccaccg

SEQ ID NO: 34667 - DNA, 16 bp, Artificial Sequence
  synthetic [barcode part1]
cagataccaataggac

SEQ ID NO: 34668 - DNA, 16 bp, Artificial Sequence
  synthetic [barcode part1]
tggtgattcaacggtc

SEQ ID NO: 34669 - DNA, 16 bp, Artificial Sequence
  synthetic [barcode part1]
ccaatccacaaccacc

SEQ ID NO: 34670 - DNA, 16 bp, Artificial Sequence
  synthetic [barcode part1]
cggttctcgtacaacc

SEQ ID NO: 34671 - DNA, 16 bp, Artificial Sequence
  synthetic [barcode part1]
taagtccgagtctgtg

SEQ ID NO: 34672 - DNA, 16 bp, Artificial Sequence
  synthetic [barcode part1]
acagatacgagacttg

SEQ ID NO: 34673 - DNA, 16 bp, Artificial Sequence
  synthetic [barcode part1]
gacacgactcgtattg

SEQ ID NO: 34674 - DNA, 16 bp, Artificial Sequence
  synthetic [barcode part1]
aaccacttagaccgtg

SEQ ID NO: 34675 - DNA, 16 bp, Artificial Sequence
  synthetic [barcode part1]
gaccttccgcagattc

SEQ ID NO: 34676 - DNA, 16 bp, Artificial Sequence
  synthetic [barcode part1]
tcggttaagttggtcg

SEQ ID NO: 34677 - DNA, 16 bp, Artificial Sequence
  synthetic [barcode part1]
tgaaccgtgtacttct

SEQ ID NO: 34678 - DNA, 16 bp, Artificial Sequence
  synthetic [barcode part1]
gaccttatcgcctacg

SEQ ID NO: 34679 - DNA, 16 bp, Artificial Sequence
  synthetic [barcode part1]
cgttcgttgtctgttc

SEQ ID NO: 34680 - DNA, 16 bp, Artificial Sequence
  synthetic [barcode part1]
gtgtaacctggaggac

SEQ ID NO: 34681 - DNA, 16 bp, Artificial Sequence
  synthetic [barcode part1]
gactcaagacctagtc

SEQ ID NO: 34682 - DNA, 16 bp, Artificial Sequence
  synthetic [barcode part1]
atctgcaacgttcgag

SEQ ID NO: 34683 - DNA, 16 bp, Artificial Sequence
  synthetic [barcode part1]
cgagtgtcagtcctct

SEQ ID NO: 34684 - DNA, 16 bp, Artificial Sequence
  synthetic [barcode part1]
gtaataggacgtactg

SEQ ID NO: 34685 - DNA, 16 bp, Artificial Sequence
  synthetic [barcode part1]
gtcacttccacaagtt

SEQ ID NO: 34686 - DNA, 16 bp, Artificial Sequence
  synthetic [barcode part1]
atacaagaacgacctg

SEQ ID NO: 34687 - DNA, 16 bp, Artificial Sequence
  synthetic [barcode part1]
ttcaccggagaactac

SEQ ID NO: 34688 - DNA, 16 bp, Artificial Sequence
  synthetic [barcode part1]
tctggaatctcctctc

SEQ ID NO: 34689 - DNA, 16 bp, Artificial Sequence
  synthetic [barcode part1]
tcaccgcaccttactt

SEQ ID NO: 34690 - DNA, 16 bp, Artificial Sequence
  synthetic [barcode part1]
tcgatcaggaaggaag

SEQ ID NO: 34691 - DNA, 16 bp, Artificial Sequence
  synthetic [barcode part1]
cggatacactacttct

SEQ ID NO: 34692 - DNA, 16 bp, Artificial Sequence
  synthetic [barcode part1]
atactccggttcagtt

SEQ ID NO: 34693 - DNA, 16 bp, Artificial Sequence
  synthetic [barcode part1]
cgtctctaatcactag

SEQ ID NO: 34694 - DNA, 16 bp, Artificial Sequence
  synthetic [barcode part1]
accggaacggttacag

SEQ ID NO: 34695 - DNA, 16 bp, Artificial Sequence
  synthetic [barcode part1]
agaaccttaagtaggc

SEQ ID NO: 34696 - DNA, 16 bp, Artificial Sequence
  synthetic [barcode part1]
cctactggtacggttc

SEQ ID NO: 34697 - DNA, 16 bp, Artificial Sequence
  synthetic [barcode part1]
caggatcgactaacct

SEQ ID NO: 34698 - DNA, 16 bp, Artificial Sequence
  synthetic [barcode part1]
cagtgcctgttcgttg

SEQ ID NO: 34699 - DNA, 16 bp, Artificial Sequence
  synthetic [barcode part1]
gtaggcaagtattgtg

SEQ ID NO: 34700 - DNA, 16 bp, Artificial Sequence
  synthetic [barcode part1]
actggtataggtccac

SEQ ID NO: 34701 - DNA, 16 bp, Artificial Sequence
  synthetic [barcode part1]
cggtgactcttgtgtc

SEQ ID NO: 34702 - DNA, 16 bp, Artificial Sequence
  synthetic [barcode part1]
ttacggagacggcaac

SEQ ID NO: 34703 - DNA, 16 bp, Artificial Sequence
  synthetic [barcode part1]
actaacgcaagttcgc

SEQ ID NO: 34704 - DNA, 16 bp, Artificial Sequence
  synthetic [barcode part1]
tccgtctgttctggag

SEQ ID NO: 34705 - DNA, 16 bp, Artificial Sequence
  synthetic [barcode part1]
gtgtactccgttaccg

SEQ ID NO: 34706 - DNA, 16 bp, Artificial Sequence
  synthetic [barcode part1]
tgattcgtcgtacttg

SEQ ID NO: 34707 - DNA, 16 bp, Artificial Sequence
  synthetic [barcode part1]
cctattagtacttggc

SEQ ID NO: 34708 - DNA, 16 bp, Artificial Sequence
  synthetic [barcode part1]
ccgaggtattcacctc

SEQ ID NO: 34709 - DNA, 16 bp, Artificial Sequence
  synthetic [barcode part1]
aaggattccaggagag

SEQ ID NO: 34710 - DNA, 16 bp, Artificial Sequence
  synthetic [barcode part1]
aactcggccttcgtgt

SEQ ID NO: 34711 - DNA, 16 bp, Artificial Sequence
  synthetic [barcode part1]
cgtgaagaaggatacg

SEQ ID NO: 34712 - DNA, 16 bp, Artificial Sequence
  synthetic [barcode part1]
tgcggtggtctatctc

SEQ ID NO: 34713 - DNA, 16 bp, Artificial Sequence
  synthetic [barcode part1]
taccaaggacaactcc

SEQ ID NO: 34714 - DNA, 16 bp, Artificial Sequence
  synthetic [barcode part1]
tcgaacgccacaagtt

SEQ ID NO: 34715 - DNA, 16 bp, Artificial Sequence
  synthetic [barcode part1]
tgtgaacacttgtggc

SEQ ID NO: 34716 - DNA, 16 bp, Artificial Sequence
  synthetic [barcode part1]
ccgagattctggaact

SEQ ID NO: 34717 - DNA, 16 bp, Artificial Sequence
  synthetic [barcode part1]
taacgaccgtgaggac

SEQ ID NO: 34718 - DNA, 16 bp, Artificial Sequence
  synthetic [barcode part1]
tctcgtgccgaattgc

SEQ ID NO: 34719 - DNA, 16 bp, Artificial Sequence
  synthetic [barcode part1]
aagaaggtgattggcg

SEQ ID NO: 34720 - DNA, 16 bp, Artificial Sequence
  synthetic [barcode part1]
atatctatccgttgcg

SEQ ID NO: 34721 - DNA, 16 bp, Artificial Sequence
  synthetic [barcode part1]
tcctattcaggcgtcg

SEQ ID NO: 34722 - DNA, 16 bp, Artificial Sequence
  synthetic [barcode part1]
actggatacgaaggcc

SEQ ID NO: 34723 - DNA, 16 bp, Artificial Sequence
  synthetic [barcode part1]
aatctatcaccgtctg

SEQ ID NO: 34724 - DNA, 16 bp, Artificial Sequence
  synthetic [barcode part1]
ttgcaggatagagtgt

SEQ ID NO: 34725 - DNA, 16 bp, Artificial Sequence
  synthetic [barcode part1]
aaccagtacacgtgtc

SEQ ID NO: 34726 - DNA, 16 bp, Artificial Sequence
  synthetic [barcode part1]
gtatctgcggaacgag

SEQ ID NO: 34727 - DNA, 16 bp, Artificial Sequence
  synthetic [barcode part1]
gattggtgactgactc

SEQ ID NO: 34728 - DNA, 16 bp, Artificial Sequence
  synthetic [barcode part1]
acagtaataccgacag

SEQ ID NO: 34729 - DNA, 16 bp, Artificial Sequence
  synthetic [barcode part1]
ttcgattgcgttaacc

SEQ ID NO: 34730 - DNA, 16 bp, Artificial Sequence
  synthetic [barcode part1]
cgttagatcactaggc

SEQ ID NO: 34731 - DNA, 16 bp, Artificial Sequence
  synthetic [barcode part1]
cgaagtctgcagtgtt

SEQ ID NO: 34732 - DNA, 16 bp, Artificial Sequence
  synthetic [barcode part1]
cgtcgttcgccaatac

SEQ ID NO: 34733 - DNA, 16 bp, Artificial Sequence
  synthetic [barcode part1]
gcagttgtgacacact

SEQ ID NO: 34734 - DNA, 16 bp, Artificial Sequence
  synthetic [barcode part1]
ttgtgtgagaaggttg

SEQ ID NO: 34735 - DNA, 16 bp, Artificial Sequence
  synthetic [barcode part1]
aaccgattacgcacac

SEQ ID NO: 34736 - DNA, 16 bp, Artificial Sequence
  synthetic [barcode part1]
cagtgcacaacttctt

SEQ ID NO: 34737 - DNA, 16 bp, Artificial Sequence
  synthetic [barcode part1]
ttcctaggtcaacgtt

SEQ ID NO: 34738 - DNA, 16 bp, Artificial Sequence
  synthetic [barcode part1]
ttgcggaagtaacagt

SEQ ID NO: 34739 - DNA, 16 bp, Artificial Sequence
  synthetic [barcode part1]
aaggcctctcgagatt

SEQ ID NO: 34740 - DNA, 16 bp, Artificial Sequence
  synthetic [barcode part1]
agagttagtcgtcctg

SEQ ID NO: 34741 - DNA, 16 bp, Artificial Sequence
  synthetic [barcode part1]
agttcgtggtggaacg

SEQ ID NO: 34742 - DNA, 16 bp, Artificial Sequence
  synthetic [barcode part1]
aacgagatcctcgact

SEQ ID NO: 34743 - DNA, 16 bp, Artificial Sequence
  synthetic [barcode part1]
tacttactcgcgacgc

SEQ ID NO: 34744 - DNA, 16 bp, Artificial Sequence
  synthetic [barcode part1]
tagtgactgacttggc

SEQ ID NO: 34745 - DNA, 16 bp, Artificial Sequence
  synthetic [barcode part1]
agttgcgaactctctt

SEQ ID NO: 34746 - DNA, 16 bp, Artificial Sequence
  synthetic [barcode part1]
tcggtgagtagaagtt

SEQ ID NO: 34747 - DNA, 16 bp, Artificial Sequence
  synthetic [barcode part1]
gatcttccttccgact

SEQ ID NO: 34748 - DNA, 16 bp, Artificial Sequence
  synthetic [barcode part1]
agtgaatctacggtag

SEQ ID NO: 34749 - DNA, 16 bp, Artificial Sequence
  synthetic [barcode part1]
tatacctacggcctgc

SEQ ID NO: 34750 - DNA, 16 bp, Artificial Sequence
  synthetic [barcode part1]
acgttggtgtggatct

SEQ ID NO: 34751 - DNA, 16 bp, Artificial Sequence
  synthetic [barcode part1]
gtccacctaggtaagt

SEQ ID NO: 34752 - DNA, 16 bp, Artificial Sequence
  synthetic [barcode part1]
cgattccactacgcac

SEQ ID NO: 34753 - DNA, 16 bp, Artificial Sequence
  synthetic [barcode part1]
cgtcttgtgtccagac

SEQ ID NO: 34754 - DNA, 16 bp, Artificial Sequence
  synthetic [barcode part1]
aagacgcgattcggtg

SEQ ID NO: 34755 - DNA, 16 bp, Artificial Sequence
  synthetic [barcode part1]
aaggatattcggcaac

SEQ ID NO: 34756 - DNA, 16 bp, Artificial Sequence
  synthetic [barcode part1]
ccgacgtcaactatag

SEQ ID NO: 34757 - DNA, 16 bp, Artificial Sequence
  synthetic [barcode part1]
atacaaggtagtccag

SEQ ID NO: 34758 - DNA, 16 bp, Artificial Sequence
  synthetic [barcode part1]
actacgatactgcgac

SEQ ID NO: 34759 - DNA, 16 bp, Artificial Sequence
  synthetic [barcode part1]
gtagaataccttgccg

SEQ ID NO: 34760 - DNA, 16 bp, Artificial Sequence
  synthetic [barcode part1]
tacttcactgcagatc

SEQ ID NO: 34761 - DNA, 16 bp, Artificial Sequence
  synthetic [barcode part1]
ccaacgcctctaactg

SEQ ID NO: 34762 - DNA, 16 bp, Artificial Sequence
  synthetic [barcode part1]
tcaagattcgtggcgt

SEQ ID NO: 34763 - DNA, 16 bp, Artificial Sequence
  synthetic [barcode part1]
cgtgaatactctactc

SEQ ID NO: 34764 - DNA, 16 bp, Artificial Sequence
  synthetic [barcode part1]
ttctggatctacctag

SEQ ID NO: 34765 - DNA, 16 bp, Artificial Sequence
  synthetic [barcode part1]
aactcgagactactgc

SEQ ID NO: 34766 - DNA, 16 bp, Artificial Sequence
  synthetic [barcode part1]
gatctctcgacaaggt

SEQ ID NO: 34767 - DNA, 16 bp, Artificial Sequence
  synthetic [barcode part1]
tatagttgccaccttg

SEQ ID NO: 34768 - DNA, 16 bp, Artificial Sequence
  synthetic [barcode part1]
gtatcggcgaccttct

SEQ ID NO: 34769 - DNA, 16 bp, Artificial Sequence
  synthetic [barcode part1]
gtgttacgtgaacaag

SEQ ID NO: 34770 - DNA, 16 bp, Artificial Sequence
  synthetic [barcode part1]
ttcaacttagtacgcc

SEQ ID NO: 34771 - DNA, 16 bp, Artificial Sequence
  synthetic [barcode part1]
actctaccggaagact

SEQ ID NO: 34772 - DNA, 16 bp, Artificial Sequence
  synthetic [barcode part1]
acacttcaccgaatct

SEQ ID NO: 34773 - DNA, 16 bp, Artificial Sequence
  synthetic [barcode part1]
ccaggtaccacgaatt

SEQ ID NO: 34774 - DNA, 16 bp, Artificial Sequence
  synthetic [barcode part1]
gaggatcgttgacacg

SEQ ID NO: 34775 - DNA, 16 bp, Artificial Sequence
  synthetic [barcode part1]
acgaattggccacgtt

SEQ ID NO: 34776 - DNA, 16 bp, Artificial Sequence
  synthetic [barcode part1]
tcagatcggagacgtg

SEQ ID NO: 34777 - DNA, 16 bp, Artificial Sequence
  synthetic [barcode part1]
tcaacaggagtcactc

SEQ ID NO: 34778 - DNA, 16 bp, Artificial Sequence
  synthetic [barcode part1]
gtaggacgcagacttg

SEQ ID NO: 34779 - DNA, 16 bp, Artificial Sequence
  synthetic [barcode part1]
atccagagtagtgaac

SEQ ID NO: 34780 - DNA, 16 bp, Artificial Sequence
  synthetic [barcode part1]
cactattggtgtactc

SEQ ID NO: 34781 - DNA, 16 bp, Artificial Sequence
  synthetic [barcode part1]
aattggactcgactcg

SEQ ID NO: 34782 - DNA, 16 bp, Artificial Sequence
  synthetic [barcode part1]
acttgtgagaacggcg

SEQ ID NO: 34783 - DNA, 16 bp, Artificial Sequence
  synthetic [barcode part1]
attcctagacgatctc

SEQ ID NO: 34784 - DNA, 16 bp, Artificial Sequence
  synthetic [barcode part1]
tgtggattgaggcgac

SEQ ID NO: 34785 - DNA, 16 bp, Artificial Sequence
  synthetic [barcode part1]
accgcaacagagtctt

SEQ ID NO: 34786 - DNA, 16 bp, Artificial Sequence
  synthetic [barcode part1]
tcgtccagtaatactc

SEQ ID NO: 34787 - DNA, 16 bp, Artificial Sequence
  synthetic [barcode part1]
caggtcgtcaacaatc

SEQ ID NO: 34788 - DNA, 16 bp, Artificial Sequence
  synthetic [barcode part1]
ttggagtggtaagtac

SEQ ID NO: 34789 - DNA, 16 bp, Artificial Sequence
  synthetic [barcode part1]
aacctactctggacag

SEQ ID NO: 34790 - DNA, 16 bp, Artificial Sequence
  synthetic [barcode part1]
agtacacctccagtcc

SEQ ID NO: 34791 - DNA, 16 bp, Artificial Sequence
  synthetic [barcode part1]
attgcggagtgtcact

SEQ ID NO: 34792 - DNA, 16 bp, Artificial Sequence
  synthetic [barcode part1]
cgaagaggaagagttc

SEQ ID NO: 34793 - DNA, 16 bp, Artificial Sequence
  synthetic [barcode part1]
aggacacacgtaagag

SEQ ID NO: 34794 - DNA, 16 bp, Artificial Sequence
  synthetic [barcode part1]
tatatcctcaccagac

SEQ ID NO: 34795 - DNA, 16 bp, Artificial Sequence
  synthetic [barcode part1]
cggagttgagacttct

SEQ ID NO: 34796 - DNA, 16 bp, Artificial Sequence
  synthetic [barcode part1]
cggccagtgattgatt

SEQ ID NO: 34797 - DNA, 16 bp, Artificial Sequence
  synthetic [barcode part1]
atccggataccgcctt

SEQ ID NO: 34798 - DNA, 16 bp, Artificial Sequence
  synthetic [barcode part1]
tcgaataacgacaggt

SEQ ID NO: 34799 - DNA, 16 bp, Artificial Sequence
  synthetic [barcode part1]
tgcaatcaccgttccg

SEQ ID NO: 34800 - DNA, 16 bp, Artificial Sequence
  synthetic [barcode part1]
cgcagaacgatctgag

SEQ ID NO: 34801 - DNA, 16 bp, Artificial Sequence
  synthetic [barcode part1]
ttgactcactctccgt

SEQ ID NO: 34802 - DNA, 16 bp, Artificial Sequence
  synthetic [barcode part1]
cgactagagtcgactt

SEQ ID NO: 34803 - DNA, 16 bp, Artificial Sequence
  synthetic [barcode part1]
tccgattccaggaagt

SEQ ID NO: 34804 - DNA, 16 bp, Artificial Sequence
  synthetic [barcode part1]
aattccttcctcggtc

SEQ ID NO: 34805 - DNA, 16 bp, Artificial Sequence
  synthetic [barcode part1]
aggcctgtaggagatc

SEQ ID NO: 34806 - DNA, 16 bp, Artificial Sequence
  synthetic [barcode part1]
gatcggcaattccaac

SEQ ID NO: 34807 - DNA, 16 bp, Artificial Sequence
  synthetic [barcode part1]
tcagaactgttacggc

SEQ ID NO: 34808 - DNA, 16 bp, Artificial Sequence
  synthetic [barcode part1]
gtggcacctaattgac

SEQ ID NO: 34809 - DNA, 16 bp, Artificial Sequence
  synthetic [barcode part1]
gacttagttcctgcgc

SEQ ID NO: 34810 - DNA, 16 bp, Artificial Sequence
  synthetic [barcode part1]
ttggcggacttaacac

SEQ ID NO: 34811 - DNA, 16 bp, Artificial Sequence
  synthetic [barcode part1]
caattgcctgttatcg

SEQ ID NO: 34812 - DNA, 16 bp, Artificial Sequence
  synthetic [barcode part1]
cacggacctacttcac

SEQ ID NO: 34813 - DNA, 16 bp, Artificial Sequence
  synthetic [barcode part1]
tctctccgttgtggtt

SEQ ID NO: 34814 - DNA, 16 bp, Artificial Sequence
  synthetic [barcode part1]
tagaccaccaacaacc

SEQ ID NO: 34815 - DNA, 16 bp, Artificial Sequence
  synthetic [barcode part1]
taaccagaccgcaatc

SEQ ID NO: 34816 - DNA, 16 bp, Artificial Sequence
  synthetic [barcode part1]
gccgaattctgacagt

SEQ ID NO: 34817 - DNA, 16 bp, Artificial Sequence
  synthetic [barcode part1]
caacgtacagtgaggc

SEQ ID NO: 34818 - DNA, 16 bp, Artificial Sequence
  synthetic [barcode part1]
gataggaagttgcgtt

SEQ ID NO: 34819 - DNA, 16 bp, Artificial Sequence
  synthetic [barcode part1]
aaggaaggccagttag

SEQ ID NO: 34820 - DNA, 16 bp, Artificial Sequence
  synthetic [barcode part1]
gatctgatcagaccac

SEQ ID NO: 34821 - DNA, 16 bp, Artificial Sequence
  synthetic [barcode part1]
gttgtactgtgagtcg

SEQ ID NO: 34822 - DNA, 16 bp, Artificial Sequence
  synthetic [barcode part1]
ttagagtcacctacct

SEQ ID NO: 34823 - DNA, 16 bp, Artificial Sequence
  synthetic [barcode part1]
aaccggttaaccggtt

SEQ ID NO: 34824 - DNA, 16 bp, Artificial Sequence
  synthetic [barcode part1]
cggttgatcaagacct

SEQ ID NO: 34825 - DNA, 16 bp, Artificial Sequence
  synthetic [barcode part1]
cgtgaagattgaatcg

SEQ ID NO: 34826 - DNA, 16 bp, Artificial Sequence
  synthetic [barcode part1]
gaagagtctgcacggt

SEQ ID NO: 34827 - DNA, 16 bp, Artificial Sequence
  synthetic [barcode part1]
cgcaatagagtggacc

SEQ ID NO: 34828 - DNA, 16 bp, Artificial Sequence
  synthetic [barcode part1]
taatagtcgcagagac

SEQ ID NO: 34829 - DNA, 16 bp, Artificial Sequence
  synthetic [barcode part1]
tctgttaccgacacgc

SEQ ID NO: 34830 - DNA, 16 bp, Artificial Sequence
  synthetic [barcode part1]
gtacggcggagttaac

SEQ ID NO: 34831 - DNA, 16 bp, Artificial Sequence
  synthetic [barcode part1]
gcgcgatctagagaac

SEQ ID NO: 34832 - DNA, 16 bp, Artificial Sequence
  synthetic [barcode part1]
tacaattcgatctccg

SEQ ID NO: 34833 - DNA, 16 bp, Artificial Sequence
  synthetic [barcode part1]
gtattggagtcgtgtc

SEQ ID NO: 34834 - DNA, 16 bp, Artificial Sequence
  synthetic [barcode part1]
gtgttagtctctaacc

SEQ ID NO: 34835 - DNA, 16 bp, Artificial Sequence
  synthetic [barcode part1]
agtggacaacaccacg

SEQ ID NO: 34836 - DNA, 16 bp, Artificial Sequence
  synthetic [barcode part1]
ccaacgaccgtactct

SEQ ID NO: 34837 - DNA, 16 bp, Artificial Sequence
  synthetic [barcode part1]
cggcgtgtagtgaagt

SEQ ID NO: 34838 - DNA, 16 bp, Artificial Sequence
  synthetic [barcode part1]
aagatcctcgttcgcc

SEQ ID NO: 34839 - DNA, 16 bp, Artificial Sequence
  synthetic [barcode part1]
tctgacctaaccgtgc

SEQ ID NO: 34840 - DNA, 16 bp, Artificial Sequence
  synthetic [barcode part1]
cacaatcgaagtagtg

SEQ ID NO: 34841 - DNA, 16 bp, Artificial Sequence
  synthetic [barcode part1]
ccgttggttaacaacg

SEQ ID NO: 34842 - DNA, 16 bp, Artificial Sequence
  synthetic [barcode part1]
cggtcgttattccacg

SEQ ID NO: 34843 - DNA, 16 bp, Artificial Sequence
  synthetic [barcode part1]
tcttgtaattgtcggc

SEQ ID NO: 34844 - DNA, 16 bp, Artificial Sequence
  synthetic [barcode part1]
tcgtgttgagtcgcct

SEQ ID NO: 34845 - DNA, 16 bp, Artificial Sequence
  synthetic [barcode part1]
gagagaagtgtcacag

SEQ ID NO: 34846 - DNA, 16 bp, Artificial Sequence
  synthetic [barcode part1]
ttcagttgcacgccac

SEQ ID NO: 34847 - DNA, 16 bp, Artificial Sequence
  synthetic [barcode part1]
gtgactatctctcaac

SEQ ID NO: 34848 - DNA, 16 bp, Artificial Sequence
  synthetic [barcode part1]
tatcactgacgtgttc

SEQ ID NO: 34849 - DNA, 16 bp, Artificial Sequence
  synthetic [barcode part1]
tacagactccgttatc

SEQ ID NO: 34850 - DNA, 16 bp, Artificial Sequence
  synthetic [barcode part1]
tcaccaagtactcttg

SEQ ID NO: 34851 - DNA, 16 bp, Artificial Sequence
  synthetic [barcode part1]
tattgcctatcgacgt

SEQ ID NO: 34852 - DNA, 16 bp, Artificial Sequence
  synthetic [barcode part1]
attctctcggtgcacg

SEQ ID NO: 34853 - DNA, 16 bp, Artificial Sequence
  synthetic [barcode part1]
aaggttcgtggacgac

SEQ ID NO: 34854 - DNA, 16 bp, Artificial Sequence
  synthetic [barcode part1]
accaatcaggatcctg

SEQ ID NO: 34855 - DNA, 16 bp, Artificial Sequence
  synthetic [barcode part1]
ttccgattggtcctct

SEQ ID NO: 34856 - DNA, 16 bp, Artificial Sequence
  synthetic [barcode part1]
tccttgaagaggacct

SEQ ID NO: 34857 - DNA, 16 bp, Artificial Sequence
  synthetic [barcode part1]
tgaacaacgcctatcg

SEQ ID NO: 34858 - DNA, 16 bp, Artificial Sequence
  synthetic [barcode part1]
tgaggttagtcgatcc

SEQ ID NO: 34859 - DNA, 16 bp, Artificial Sequence
  synthetic [barcode part1]
atacgtcgcaactacg

SEQ ID NO: 34860 - DNA, 16 bp, Artificial Sequence
  synthetic [barcode part1]
gaacagagtaggtggt

SEQ ID NO: 34861 - DNA, 16 bp, Artificial Sequence
  synthetic [barcode part1]
cagtgatcgtggagac

SEQ ID NO: 34862 - DNA, 16 bp, Artificial Sequence
  synthetic [barcode part1]
gtcgcctaacgaagtt

SEQ ID NO: 34863 - DNA, 16 bp, Artificial Sequence
  synthetic [barcode part1]
cgtctggtagtgagag

SEQ ID NO: 34864 - DNA, 16 bp, Artificial Sequence
  synthetic [barcode part1]
tgaatacctggcgtgt

SEQ ID NO: 34865 - DNA, 16 bp, Artificial Sequence
  synthetic [barcode part1]
caattgagaccggtct

SEQ ID NO: 34866 - DNA, 16 bp, Artificial Sequence
  synthetic [barcode part1]
gtcgtaagacggacac

SEQ ID NO: 34867 - DNA, 16 bp, Artificial Sequence
  synthetic [barcode part1]
tgaccttggtcctctt

SEQ ID NO: 34868 - DNA, 16 bp, Artificial Sequence
  synthetic [barcode part1]
gacggttgatcactgt

SEQ ID NO: 34869 - DNA, 16 bp, Artificial Sequence
  synthetic [barcode part1]
gccgataatccaggtt

SEQ ID NO: 34870 - DNA, 16 bp, Artificial Sequence
  synthetic [barcode part1]
agacgagtgtcgcaac

SEQ ID NO: 34871 - DNA, 16 bp, Artificial Sequence
  synthetic [barcode part1]
cacgattattgtctcg

SEQ ID NO: 34872 - DNA, 16 bp, Artificial Sequence
  synthetic [barcode part1]
ccgtggtaccaattag

SEQ ID NO: 34873 - DNA, 16 bp, Artificial Sequence
  synthetic [barcode part1]
tgcgacactcgaagtt

SEQ ID NO: 34874 - DNA, 16 bp, Artificial Sequence
  synthetic [barcode part1]
gcggatcctgatatac

SEQ ID NO: 34875 - DNA, 16 bp, Artificial Sequence
  synthetic [barcode part1]
acggagatcaagtcgc

SEQ ID NO: 34876 - DNA, 16 bp, Artificial Sequence
  synthetic [barcode part1]
gtaactccactgaacg

SEQ ID NO: 34877 - DNA, 16 bp, Artificial Sequence
  synthetic [barcode part1]
cctgattctctccagt

SEQ ID NO: 34878 - DNA, 16 bp, Artificial Sequence
  synthetic [barcode part1]
gttctgactgatcgag

SEQ ID NO: 34879 - DNA, 16 bp, Artificial Sequence
  synthetic [barcode part1]
atatacaacgccgcac

SEQ ID NO: 34880 - DNA, 16 bp, Artificial Sequence
  synthetic [barcode part1]
gataattctccacgtc

SEQ ID NO: 34881 - DNA, 16 bp, Artificial Sequence
  synthetic [barcode part1]
aagtaagacctgcctc

SEQ ID NO: 34882 - DNA, 16 bp, Artificial Sequence
  synthetic [barcode part1]
taccttaccgtcctac

SEQ ID NO: 34883 - DNA, 16 bp, Artificial Sequence
  synthetic [barcode part1]
tagttcgcggattacg

SEQ ID NO: 34884 - DNA, 16 bp, Artificial Sequence
  synthetic [barcode part1]
aaggaacaacggcagt

SEQ ID NO: 34885 - DNA, 16 bp, Artificial Sequence
  synthetic [barcode part1]
gccactccgagtactt

SEQ ID NO: 34886 - DNA, 16 bp, Artificial Sequence
  synthetic [barcode part1]
tcactactcacgagtt

SEQ ID NO: 34887 - DNA, 16 bp, Artificial Sequence
  synthetic [barcode part1]
acaatagtccacgaag

SEQ ID NO: 34888 - DNA, 16 bp, Artificial Sequence
  synthetic [barcode part1]
aaccacgtctcaactt

SEQ ID NO: 34889 - DNA, 16 bp, Artificial Sequence
  synthetic [barcode part1]
cggtacacgacgaagt

SEQ ID NO: 34890 - DNA, 16 bp, Artificial Sequence
  synthetic [barcode part1]
ttagattcgcagagag

SEQ ID NO: 34891 - DNA, 16 bp, Artificial Sequence
  synthetic [barcode part1]
agtgtcagatctcgac

SEQ ID NO: 34892 - DNA, 16 bp, Artificial Sequence
  synthetic [barcode part1]
aacacgttcgattctc

SEQ ID NO: 34893 - DNA, 16 bp, Artificial Sequence
  synthetic [barcode part1]
tattccgcgtccgagt

SEQ ID NO: 34894 - DNA, 16 bp, Artificial Sequence
  synthetic [barcode part1]
tgcgtcggattcttcg

SEQ ID NO: 34895 - DNA, 16 bp, Artificial Sequence
  synthetic [barcode part1]
tggtctaagtgtgaag

SEQ ID NO: 34896 - DNA, 16 bp, Artificial Sequence
  synthetic [barcode part1]
gtaatagtcgtacgag

SEQ ID NO: 34897 - DNA, 16 bp, Artificial Sequence
  synthetic [barcode part1]
attccacggtatacct

SEQ ID NO: 34898 - DNA, 16 bp, Artificial Sequence
  synthetic [barcode part1]
acacgactaaccgtgt

SEQ ID NO: 34899 - DNA, 16 bp, Artificial Sequence
  synthetic [barcode part1]
ttacaatcgtggcacg

SEQ ID NO: 34900 - DNA, 16 bp, Artificial Sequence
  synthetic [barcode part1]
acctaaggttcgcaac

SEQ ID NO: 34901 - DNA, 16 bp, Artificial Sequence
  synthetic [barcode part1]
gcgttagtctcgtcgt

SEQ ID NO: 34902 - DNA, 16 bp, Artificial Sequence
  synthetic [barcode part1]
caggaacttcaacaag

SEQ ID NO: 34903 - DNA, 16 bp, Artificial Sequence
  synthetic [barcode part1]
cgttatcggcgtgtct

SEQ ID NO: 34904 - DNA, 16 bp, Artificial Sequence
  synthetic [barcode part1]
tgtgtagacgagatac

SEQ ID NO: 34905 - DNA, 16 bp, Artificial Sequence
  synthetic [barcode part1]
tgcaccttctgtatcc

SEQ ID NO: 34906 - DNA, 16 bp, Artificial Sequence
  synthetic [barcode part1]
acctactcgtctacct

SEQ ID NO: 34907 - DNA, 16 bp, Artificial Sequence
  synthetic [barcode part1]
tctcgtctgttcggag

SEQ ID NO: 34908 - DNA, 16 bp, Artificial Sequence
  synthetic [barcode part1]
agacaaggtgacgcct

SEQ ID NO: 34909 - DNA, 16 bp, Artificial Sequence
  synthetic [barcode part1]
tacttgtccactcgtc

SEQ ID NO: 34910 - DNA, 16 bp, Artificial Sequence
  synthetic [barcode part1]
cagacgttgcagactt

SEQ ID NO: 34911 - DNA, 16 bp, Artificial Sequence
  synthetic [barcode part1]
gacagtgttcaggcag

SEQ ID NO: 34912 - DNA, 16 bp, Artificial Sequence
  synthetic [barcode part1]
ccaggtaacagtaagt

SEQ ID NO: 34913 - DNA, 16 bp, Artificial Sequence
  synthetic [barcode part1]
taactgaccggtcagt

SEQ ID NO: 34914 - DNA, 16 bp, Artificial Sequence
  synthetic [barcode part1]
ttggtcaactgaccag

SEQ ID NO: 34915 - DNA, 16 bp, Artificial Sequence
  synthetic [barcode part1]
gattgtgacaccgatc

SEQ ID NO: 34916 - DNA, 16 bp, Artificial Sequence
  synthetic [barcode part1]
atcggcacgagaggtt

SEQ ID NO: 34917 - DNA, 16 bp, Artificial Sequence
  synthetic [barcode part1]
atcctgccagagaatc

SEQ ID NO: 34918 - DNA, 16 bp, Artificial Sequence
  synthetic [barcode part1]
aacgtgttggtgtacc

SEQ ID NO: 34919 - DNA, 16 bp, Artificial Sequence
  synthetic [barcode part1]
gtgcaagataaggacg

SEQ ID NO: 34920 - DNA, 16 bp, Artificial Sequence
  synthetic [barcode part1]
tcgttatacctacgac

SEQ ID NO: 34921 - DNA, 16 bp, Artificial Sequence
  synthetic [barcode part1]
tattcgcgcggtacct

SEQ ID NO: 34922 - DNA, 16 bp, Artificial Sequence
  synthetic [barcode part1]
cgtgacggaatagacc

SEQ ID NO: 34923 - DNA, 16 bp, Artificial Sequence
  synthetic [barcode part1]
aacgcgtggtcttcct

SEQ ID NO: 34924 - DNA, 16 bp, Artificial Sequence
  synthetic [barcode part1]
tcctgaagacgaatag

SEQ ID NO: 34925 - DNA, 16 bp, Artificial Sequence
  synthetic [barcode part1]
acgtacgtgtgacgtt

SEQ ID NO: 34926 - DNA, 16 bp, Artificial Sequence
  synthetic [barcode part1]
gtcacttgtagacctt

SEQ ID NO: 34927 - DNA, 16 bp, Artificial Sequence
  synthetic [barcode part1]
gactgtggtactggtt

SEQ ID NO: 34928 - DNA, 16 bp, Artificial Sequence
  synthetic [barcode part1]
atattgacgacaggac

SEQ ID NO: 34929 - DNA, 16 bp, Artificial Sequence
  synthetic [barcode part1]
ttcgtcacacactagt

SEQ ID NO: 34930 - DNA, 16 bp, Artificial Sequence
  synthetic [barcode part1]
caatctcttccgacct

SEQ ID NO: 34931 - DNA, 16 bp, Artificial Sequence
  synthetic [barcode part1]
tcgtccgtctagaatt

SEQ ID NO: 34932 - DNA, 16 bp, Artificial Sequence
  synthetic [barcode part1]
ttgccgtagactcgtc

SEQ ID NO: 34933 - DNA, 16 bp, Artificial Sequence
  synthetic [barcode part1]
cctatcgtgcagatcc

SEQ ID NO: 34934 - DNA, 16 bp, Artificial Sequence
  synthetic [barcode part1]
taggtggtagaatctg

SEQ ID NO: 34935 - DNA, 16 bp, Artificial Sequence
  synthetic [barcode part1]
cgattaatcgaccggt

SEQ ID NO: 34936 - DNA, 16 bp, Artificial Sequence
  synthetic [barcode part1]
tagtcgactagtcgac

SEQ ID NO: 34937 - DNA, 16 bp, Artificial Sequence
  synthetic [barcode part1]
gttgtcctccgaacac

SEQ ID NO: 34938 - DNA, 16 bp, Artificial Sequence
  synthetic [barcode part1]
tcgacagacttctact

SEQ ID NO: 34939 - DNA, 16 bp, Artificial Sequence
  synthetic [barcode part1]
caacttgcactcttag

SEQ ID NO: 34940 - DNA, 16 bp, Artificial Sequence
  synthetic [barcode part1]
cacggtccaattcctg

SEQ ID NO: 34941 - DNA, 16 bp, Artificial Sequence
  synthetic [barcode part1]
gtataaggacgatctg

SEQ ID NO: 34942 - DNA, 16 bp, Artificial Sequence
  synthetic [barcode part1]
tatccttcgacttgag

SEQ ID NO: 34943 - DNA, 16 bp, Artificial Sequence
  synthetic [barcode part1]
tgcgttatcggaggag

SEQ ID NO: 34944 - DNA, 16 bp, Artificial Sequence
  synthetic [barcode part1]
gtactaactctcggtt

SEQ ID NO: 34945 - DNA, 16 bp, Artificial Sequence
  synthetic [barcode part1]
tagttggtgacgtcac

SEQ ID NO: 34946 - DNA, 16 bp, Artificial Sequence
  synthetic [barcode part1]
agaggacctgttactc

SEQ ID NO: 34947 - DNA, 16 bp, Artificial Sequence
  synthetic [barcode part1]
agaactcaccttggac

SEQ ID NO: 34948 - DNA, 16 bp, Artificial Sequence
  synthetic [barcode part1]
tggtaacagaggcacc

SEQ ID NO: 34949 - DNA, 16 bp, Artificial Sequence
  synthetic [barcode part1]
cgacaacgtacgaggt

SEQ ID NO: 34950 - DNA, 16 bp, Artificial Sequence
  synthetic [barcode part1]
agaatactgcgttccg

SEQ ID NO: 34951 - DNA, 16 bp, Artificial Sequence
  synthetic [barcode part1]
tgtgaattcgttccgt

SEQ ID NO: 34952 - DNA, 16 bp, Artificial Sequence
  synthetic [barcode part1]
aaggcgagtggattcc

SEQ ID NO: 34953 - DNA, 16 bp, Artificial Sequence
  synthetic [barcode part1]
tccgcacgacctgatt

SEQ ID NO: 34954 - DNA, 16 bp, Artificial Sequence
  synthetic [barcode part1]
gtggtccacttgatag

SEQ ID NO: 34955 - DNA, 16 bp, Artificial Sequence
  synthetic [barcode part1]
tgcacaagaatcagac

SEQ ID NO: 34956 - DNA, 16 bp, Artificial Sequence
  synthetic [barcode part1]
attcagactcgtcgtt

SEQ ID NO: 34957 - DNA, 16 bp, Artificial Sequence
  synthetic [barcode part1]
gaaggacctacgtgac

SEQ ID NO: 34958 - DNA, 16 bp, Artificial Sequence
  synthetic [barcode part1]
tactactcctgcggac

SEQ ID NO: 34959 - DNA, 16 bp, Artificial Sequence
  synthetic [barcode part1]
agtaccgagttgacct

SEQ ID NO: 34960 - DNA, 16 bp, Artificial Sequence
  synthetic [barcode part1]
acgtactgaacactcg

SEQ ID NO: 34961 - DNA, 16 bp, Artificial Sequence
  synthetic [barcode part1]
cgtactaagagttgag

SEQ ID NO: 34962 - DNA, 16 bp, Artificial Sequence
  synthetic [barcode part1]
tgtgcctacgatccac

SEQ ID NO: 34963 - DNA, 16 bp, Artificial Sequence
  synthetic [barcode part1]
tctcgcgatatctcct

SEQ ID NO: 34964 - DNA, 16 bp, Artificial Sequence
  synthetic [barcode part1]
ttagtggtccacgtcc

SEQ ID NO: 34965 - DNA, 16 bp, Artificial Sequence
  synthetic [barcode part1]
tattcacctacctgcc

SEQ ID NO: 34966 - DNA, 16 bp, Artificial Sequence
  synthetic [barcode part1]
tggtgacctgacaact

SEQ ID NO: 34967 - DNA, 16 bp, Artificial Sequence
  synthetic [barcode part1]
tcaggtgaggcctatt

SEQ ID NO: 34968 - DNA, 16 bp, Artificial Sequence
  synthetic [barcode part1]
tcctcagtacggtcac

SEQ ID NO: 34969 - DNA, 16 bp, Artificial Sequence
  synthetic [barcode part1]
ttcaaggattggtcgc

SEQ ID NO: 34970 - DNA, 16 bp, Artificial Sequence
  synthetic [barcode part1]
tggcgtggttatcctc

SEQ ID NO: 34971 - DNA, 16 bp, Artificial Sequence
  synthetic [barcode part1]
tgtcttatctaggcac

SEQ ID NO: 34972 - DNA, 16 bp, Artificial Sequence
  synthetic [barcode part1]
tcacctccgtagatcg

SEQ ID NO: 34973 - DNA, 16 bp, Artificial Sequence
  synthetic [barcode part1]
ttggactaccactgag

SEQ ID NO: 34974 - DNA, 16 bp, Artificial Sequence
  synthetic [barcode part1]
caacaggcactatctg

SEQ ID NO: 34975 - DNA, 16 bp, Artificial Sequence
  synthetic [barcode part1]
tctggttgatcggagt

SEQ ID NO: 34976 - DNA, 16 bp, Artificial Sequence
  synthetic [barcode part1]
taccgtcgtgatcacc

SEQ ID NO: 34977 - DNA, 16 bp, Artificial Sequence
  synthetic [barcode part1]
cgtcaattgtacgacg

SEQ ID NO: 34978 - DNA, 16 bp, Artificial Sequence
  synthetic [barcode part1]
tgagacgagatcgaag

SEQ ID NO: 34979 - DNA, 16 bp, Artificial Sequence
  synthetic [barcode part1]
tccaatcgtcgcacgt

SEQ ID NO: 34980 - DNA, 16 bp, Artificial Sequence
  synthetic [barcode part1]
tggaacctgcagtact

SEQ ID NO: 34981 - DNA, 16 bp, Artificial Sequence
  synthetic [barcode part1]
actggtaagtgcactc

SEQ ID NO: 34982 - DNA, 16 bp, Artificial Sequence
  synthetic [barcode part1]
ttgtgcagaggaattg

SEQ ID NO: 34983 - DNA, 16 bp, Artificial Sequence
  synthetic [barcode part1]
gtgtcttactggatct

SEQ ID NO: 34984 - DNA, 16 bp, Artificial Sequence
  synthetic [barcode part1]
cgtctaacacgaactg

SEQ ID NO: 34985 - DNA, 16 bp, Artificial Sequence
  synthetic [barcode part1]
tgcgtagttgttacct

SEQ ID NO: 34986 - DNA, 16 bp, Artificial Sequence
  synthetic [barcode part1]
gatcaggtccaattcg

SEQ ID NO: 34987 - DNA, 16 bp, Artificial Sequence
  synthetic [barcode part1]
tgtacttccacacctc

SEQ ID NO: 34988 - DNA, 16 bp, Artificial Sequence
  synthetic [barcode part1]
ttacgacggtcctaag

SEQ ID NO: 34989 - DNA, 16 bp, Artificial Sequence
  synthetic [barcode part1]
agaggcgacttctact

SEQ ID NO: 34990 - DNA, 16 bp, Artificial Sequence
  synthetic [barcode part1]
gtgatcaacgcgttac

SEQ ID NO: 34991 - DNA, 16 bp, Artificial Sequence
  synthetic [barcode part1]
atcgtagacttcaggc

SEQ ID NO: 34992 - DNA, 16 bp, Artificial Sequence
  synthetic [barcode part1]
atacgactgcgattgc

SEQ ID NO: 34993 - DNA, 16 bp, Artificial Sequence
  synthetic [barcode part1]
gttccacaggtacctc

SEQ ID NO: 34994 - DNA, 16 bp, Artificial Sequence
  synthetic [barcode part1]
acaagttgcgtggtct

SEQ ID NO: 34995 - DNA, 16 bp, Artificial Sequence
  synthetic [barcode part1]
tgtcacacagtcagtg

SEQ ID NO: 34996 - DNA, 16 bp, Artificial Sequence
  synthetic [barcode part1]
attgtgccaattctcg

SEQ ID NO: 34997 - DNA, 16 bp, Artificial Sequence
  synthetic [barcode part1]
attgttcgcagatctc

SEQ ID NO: 34998 - DNA, 16 bp, Artificial Sequence
  synthetic [barcode part1]
actattcgcaagttcc

SEQ ID NO: 34999 - DNA, 16 bp, Artificial Sequence
  synthetic [barcode part1]
tgacacttgtctgccg

SEQ ID NO: 35000 - DNA, 16 bp, Artificial Sequence
  synthetic [barcode part1]
ttggtgagtgaagatc

SEQ ID NO: 35001 - DNA, 16 bp, Artificial Sequence
  synthetic [barcode part1]
gaccgtgagagaatcc

SEQ ID NO: 35002 - DNA, 16 bp, Artificial Sequence
  synthetic [barcode part1]
gattgtcacggaggtg

SEQ ID NO: 35003 - DNA, 16 bp, Artificial Sequence
  synthetic [barcode part1]
cagacacgaggtggtt

SEQ ID NO: 35004 - DNA, 16 bp, Artificial Sequence
  synthetic [barcode part1]
cacttcactcggacgt

SEQ ID NO: 35005 - DNA, 16 bp, Artificial Sequence
  synthetic [barcode part1]
gtacgagtcacacttg

SEQ ID NO: 35006 - DNA, 16 bp, Artificial Sequence
  synthetic [barcode part1]
taacacgattgtctcc

SEQ ID NO: 35007 - DNA, 16 bp, Artificial Sequence
  synthetic [barcode part1]
tgtagtctgacctccg

SEQ ID NO: 35008 - DNA, 16 bp, Artificial Sequence
  synthetic [barcode part1]
caactagtgactgacc

SEQ ID NO: 35009 - DNA, 16 bp, Artificial Sequence
  synthetic [barcode part1]
tgcgagttgttatcct

SEQ ID NO: 35010 - DNA, 16 bp, Artificial Sequence
  synthetic [barcode part1]
tattattccgcgcaac

SEQ ID NO: 35011 - DNA, 16 bp, Artificial Sequence
  synthetic [barcode part1]
cctgtggtcactctag

SEQ ID NO: 35012 - DNA, 16 bp, Artificial Sequence
  synthetic [barcode part1]
tctaggaagttggtcc

SEQ ID NO: 35013 - DNA, 16 bp, Artificial Sequence
  synthetic [barcode part1]
ccggagtatctgttcc

SEQ ID NO: 35014 - DNA, 16 bp, Artificial Sequence
  synthetic [barcode part1]
aagtgaagataggcgc

SEQ ID NO: 35015 - DNA, 16 bp, Artificial Sequence
  synthetic [barcode part1]
tgccggtaatcggaag

SEQ ID NO: 35016 - DNA, 16 bp, Artificial Sequence
  synthetic [barcode part1]
gttggccttaaccaag

SEQ ID NO: 35017 - DNA, 16 bp, Artificial Sequence
  synthetic [barcode part1]
aggtgagtctaagatc

SEQ ID NO: 35018 - DNA, 16 bp, Artificial Sequence
  synthetic [barcode part1]
cgaacaggtgataccg

SEQ ID NO: 35019 - DNA, 16 bp, Artificial Sequence
  synthetic [barcode part1]
aaggagaccagttgag

SEQ ID NO: 35020 - DNA, 16 bp, Artificial Sequence
  synthetic [barcode part1]
gaagtggcgttcagac

SEQ ID NO: 35021 - DNA, 16 bp, Artificial Sequence
  synthetic [barcode part1]
tatcacctgttggtgt

SEQ ID NO: 35022 - DNA, 16 bp, Artificial Sequence
  synthetic [barcode part1]
tggaagaaccagtgtt

SEQ ID NO: 35023 - DNA, 16 bp, Artificial Sequence
  synthetic [barcode part1]
taggtgtcacaccaac

SEQ ID NO: 35024 - DNA, 16 bp, Artificial Sequence
  synthetic [barcode part1]
tcctaagacggataag

SEQ ID NO: 35025 - DNA, 16 bp, Artificial Sequence
  synthetic [barcode part1]
tgcaggagtcgaatcg

SEQ ID NO: 35026 - DNA, 16 bp, Artificial Sequence
  synthetic [barcode part1]
cctcacacagtggttc

SEQ ID NO: 35027 - DNA, 16 bp, Artificial Sequence
  synthetic [barcode part1]
tccagttccagagagt

SEQ ID NO: 35028 - DNA, 16 bp, Artificial Sequence
  synthetic [barcode part1]
aggcgaatactacaac

SEQ ID NO: 35029 - DNA, 16 bp, Artificial Sequence
  synthetic [barcode part1]
agttcgacgcgaagac

SEQ ID NO: 35030 - DNA, 16 bp, Artificial Sequence
  synthetic [barcode part1]
ccagtaattcgcgtcc

SEQ ID NO: 35031 - DNA, 16 bp, Artificial Sequence
  synthetic [barcode part1]
ccgattagactctgag

SEQ ID NO: 35032 - DNA, 16 bp, Artificial Sequence
  synthetic [barcode part1]
gaggtacacacttctg

SEQ ID NO: 35033 - DNA, 16 bp, Artificial Sequence
  synthetic [barcode part1]
gtgcctgcaaggtaag

SEQ ID NO: 35034 - DNA, 16 bp, Artificial Sequence
  synthetic [barcode part1]
cggactctattcagag

SEQ ID NO: 35035 - DNA, 16 bp, Artificial Sequence
  synthetic [barcode part1]
gcaggatcagataccg

SEQ ID NO: 35036 - DNA, 16 bp, Artificial Sequence
  synthetic [barcode part1]
tcaactctcgttgcct

SEQ ID NO: 35037 - DNA, 16 bp, Artificial Sequence
  synthetic [barcode part1]
acaattgcgacgcgtt

SEQ ID NO: 35038 - DNA, 16 bp, Artificial Sequence
  synthetic [barcode part1]
aggaaccaccagtacg

SEQ ID NO: 35039 - DNA, 16 bp, Artificial Sequence
  synthetic [barcode part1]
tctgccttgcctattg

SEQ ID NO: 35040 - DNA, 16 bp, Artificial Sequence
  synthetic [barcode part1]
tgcagattgtccagac

SEQ ID NO: 35041 - DNA, 16 bp, Artificial Sequence
  synthetic [barcode part1]
cgatacgcgtaagtct

SEQ ID NO: 35042 - DNA, 16 bp, Artificial Sequence
  synthetic [barcode part1]
agtcgtacgtaaccac

SEQ ID NO: 35043 - DNA, 16 bp, Artificial Sequence
  synthetic [barcode part1]
cctcctctcagaattc

SEQ ID NO: 35044 - DNA, 16 bp, Artificial Sequence
  synthetic [barcode part1]
taggtaactcaaggtg

SEQ ID NO: 35045 - DNA, 16 bp, Artificial Sequence
  synthetic [barcode part1]
gaccacgatacgttac

SEQ ID NO: 35046 - DNA, 16 bp, Artificial Sequence
  synthetic [barcode part1]
tgcaggtgcaacaggt

SEQ ID NO: 35047 - DNA, 16 bp, Artificial Sequence
  synthetic [barcode part1]
tctgaccagttcttcc

SEQ ID NO: 35048 - DNA, 16 bp, Artificial Sequence
  synthetic [barcode part1]
tggtgccgtaggtaag

SEQ ID NO: 35049 - DNA, 16 bp, Artificial Sequence
  synthetic [barcode part1]
acagttcaacagtccg

SEQ ID NO: 35050 - DNA, 16 bp, Artificial Sequence
  synthetic [barcode part1]
tctctcgagacgtctg

SEQ ID NO: 35051 - DNA, 16 bp, Artificial Sequence
  synthetic [barcode part1]
tgtcttgacaagtcct

SEQ ID NO: 35052 - DNA, 16 bp, Artificial Sequence
  synthetic [barcode part1]
cgatcaactctccttc

SEQ ID NO: 35053 - DNA, 16 bp, Artificial Sequence
  synthetic [barcode part1]
gaactcaatccgagtc

SEQ ID NO: 35054 - DNA, 16 bp, Artificial Sequence
  synthetic [barcode part1]
gaggagttgagttcgc

SEQ ID NO: 35055 - DNA, 16 bp, Artificial Sequence
  synthetic [barcode part1]
acgaaggcaatagttc

SEQ ID NO: 35056 - DNA, 16 bp, Artificial Sequence
  synthetic [barcode part1]
taggtacaccaagaac

SEQ ID NO: 35057 - DNA, 16 bp, Artificial Sequence
  synthetic [barcode part1]
acgaatccgcactaac

SEQ ID NO: 35058 - DNA, 16 bp, Artificial Sequence
  synthetic [barcode part1]
tgatcctgtcgtgcgt

SEQ ID NO: 35059 - DNA, 16 bp, Artificial Sequence
  synthetic [barcode part1]
atccgtaagtcacacg

SEQ ID NO: 35060 - DNA, 16 bp, Artificial Sequence
  synthetic [barcode part1]
gactcagacgtgaggt

SEQ ID NO: 35061 - DNA, 16 bp, Artificial Sequence
  synthetic [barcode part1]
gtccactctacctatc

SEQ ID NO: 35062 - DNA, 16 bp, Artificial Sequence
  synthetic [barcode part1]
cgaactatctcgtgcc

SEQ ID NO: 35063 - DNA, 16 bp, Artificial Sequence
  synthetic [barcode part1]
atacgacggtctctcc

SEQ ID NO: 35064 - DNA, 16 bp, Artificial Sequence
  synthetic [barcode part1]
agtgtcggcacgtatt

SEQ ID NO: 35065 - DNA, 16 bp, Artificial Sequence
  synthetic [barcode part1]
cgaatctgccttaccg

SEQ ID NO: 35066 - DNA, 16 bp, Artificial Sequence
  synthetic [barcode part1]
cgtggatcttatcgtt

SEQ ID NO: 35067 - DNA, 16 bp, Artificial Sequence
  synthetic [barcode part1]
actcgtaacgtagtcg

SEQ ID NO: 35068 - DNA, 16 bp, Artificial Sequence
  synthetic [barcode part1]
cctcacgtaacctggt

SEQ ID NO: 35069 - DNA, 16 bp, Artificial Sequence
  synthetic [barcode part1]
ttgtgtgttctggttg

SEQ ID NO: 35070 - DNA, 16 bp, Artificial Sequence
  synthetic [barcode part1]
cgaagttactacggtc

SEQ ID NO: 35071 - DNA, 16 bp, Artificial Sequence
  synthetic [barcode part1]
gtcgttcgtctataac

SEQ ID NO: 35072 - DNA, 16 bp, Artificial Sequence
  synthetic [barcode part1]
gaagtcgtccttaacg

SEQ ID NO: 35073 - DNA, 16 bp, Artificial Sequence
  synthetic [barcode part1]
tacggtgtaagtaggt

SEQ ID NO: 35074 - DNA, 16 bp, Artificial Sequence
  synthetic [barcode part1]
cgttagatattctcgc

SEQ ID NO: 35075 - DNA, 16 bp, Artificial Sequence
  synthetic [barcode part1]
acgtcgcgaacaagtg

SEQ ID NO: 35076 - DNA, 16 bp, Artificial Sequence
  synthetic [barcode part1]
gtggtattagttggcc

SEQ ID NO: 35077 - DNA, 16 bp, Artificial Sequence
  synthetic [barcode part1]
tgtctccaattcggcg

SEQ ID NO: 35078 - DNA, 16 bp, Artificial Sequence
  synthetic [barcode part1]
tgagaggtacgatcgc

SEQ ID NO: 35079 - DNA, 16 bp, Artificial Sequence
  synthetic [barcode part1]
taggttgtgtgagaac

SEQ ID NO: 35080 - DNA, 16 bp, Artificial Sequence
  synthetic [barcode part1]
acgtcggtagtcttcc

SEQ ID NO: 35081 - DNA, 16 bp, Artificial Sequence
  synthetic [barcode part1]
gtgaaggaactaccgc

SEQ ID NO: 35082 - DNA, 16 bp, Artificial Sequence
  synthetic [barcode part1]
cctatcggtgtccaac

SEQ ID NO: 35083 - DNA, 16 bp, Artificial Sequence
  synthetic [barcode part1]
ccgtactaggtacaac

SEQ ID NO: 35084 - DNA, 16 bp, Artificial Sequence
  synthetic [barcode part1]
ttgtccactcaagact

SEQ ID NO: 35085 - DNA, 16 bp, Artificial Sequence
  synthetic [barcode part1]
attgtcgaatctggcg

SEQ ID NO: 35086 - DNA, 16 bp, Artificial Sequence
  synthetic [barcode part1]
agtctgaacgtgaggc

SEQ ID NO: 35087 - DNA, 16 bp, Artificial Sequence
  synthetic [barcode part1]
agtggagtatatcgac

SEQ ID NO: 35088 - DNA, 16 bp, Artificial Sequence
  synthetic [barcode part1]
aattgcgccttctggc

SEQ ID NO: 35089 - DNA, 16 bp, Artificial Sequence
  synthetic [barcode part1]
actacactcgaacacg

SEQ ID NO: 35090 - DNA, 16 bp, Artificial Sequence
  synthetic [barcode part1]
cgtatacaggatctcg

SEQ ID NO: 35091 - DNA, 16 bp, Artificial Sequence
  synthetic [barcode part1]
gagttcttaatcggcg

SEQ ID NO: 35092 - DNA, 16 bp, Artificial Sequence
  synthetic [barcode part1]
aagaccgagttgcacg

SEQ ID NO: 35093 - DNA, 16 bp, Artificial Sequence
  synthetic [barcode part1]
cgttcctaccgtcaag

SEQ ID NO: 35094 - DNA, 16 bp, Artificial Sequence
  synthetic [barcode part1]
tattcgcgcggatagt

SEQ ID NO: 35095 - DNA, 16 bp, Artificial Sequence
  synthetic [barcode part1]
agaatagtgtcgcctc

SEQ ID NO: 35096 - DNA, 16 bp, Artificial Sequence
  synthetic [barcode part1]
tcggagtcgaagtctt

SEQ ID NO: 35097 - DNA, 16 bp, Artificial Sequence
  synthetic [barcode part1]
caccgacagttctctg

SEQ ID NO: 35098 - DNA, 16 bp, Artificial Sequence
  synthetic [barcode part1]
gccgtaatccaaggtt

SEQ ID NO: 35099 - DNA, 16 bp, Artificial Sequence
  synthetic [barcode part1]
attggcgtccggtctt

SEQ ID NO: 35100 - DNA, 16 bp, Artificial Sequence
  synthetic [barcode part1]
atattcaggcgtccag

SEQ ID NO: 35101 - DNA, 16 bp, Artificial Sequence
  synthetic [barcode part1]
cgacagagtgaatccg

SEQ ID NO: 35102 - DNA, 16 bp, Artificial Sequence
  synthetic [barcode part1]
gtggatcttggtacgt

SEQ ID NO: 35103 - DNA, 16 bp, Artificial Sequence
  synthetic [barcode part1]
aactacaagagtcggt

SEQ ID NO: 35104 - DNA, 16 bp, Artificial Sequence
  synthetic [barcode part1]
cgtctggatacttgag

SEQ ID NO: 35105 - DNA, 16 bp, Artificial Sequence
  synthetic [barcode part1]
agtgccgacactatac

SEQ ID NO: 35106 - DNA, 16 bp, Artificial Sequence
  synthetic [barcode part1]
ttctcagtgacgtgtt

SEQ ID NO: 35107 - DNA, 16 bp, Artificial Sequence
  synthetic [barcode part1]
atctcgccgaactcac

SEQ ID NO: 35108 - DNA, 16 bp, Artificial Sequence
  synthetic [barcode part1]
tctcctgttgtcgttg

SEQ ID NO: 35109 - DNA, 16 bp, Artificial Sequence
  synthetic [barcode part1]
agtgcgtccttaatct

SEQ ID NO: 35110 - DNA, 16 bp, Artificial Sequence
  synthetic [barcode part1]
ccacacttgtcggatc

SEQ ID NO: 35111 - DNA, 16 bp, Artificial Sequence
  synthetic [barcode part1]
cctggttagaaggttc

SEQ ID NO: 35112 - DNA, 16 bp, Artificial Sequence
  synthetic [barcode part1]
accgttcgatatccgc

SEQ ID NO: 35113 - DNA, 16 bp, Artificial Sequence
  synthetic [barcode part1]
ttccacgccgaactac

SEQ ID NO: 35114 - DNA, 16 bp, Artificial Sequence
  synthetic [barcode part1]
acgaatcgtcggagac

SEQ ID NO: 35115 - DNA, 16 bp, Artificial Sequence
  synthetic [barcode part1]
gtatcagtcaggtacc

SEQ ID NO: 35116 - DNA, 16 bp, Artificial Sequence
  synthetic [barcode part1]
ttgagacaggtggacc

SEQ ID NO: 35117 - DNA, 16 bp, Artificial Sequence
  synthetic [barcode part1]
ttacgagtaaggagtc

SEQ ID NO: 35118 - DNA, 16 bp, Artificial Sequence
  synthetic [barcode part1]
gtggtatagagaggac

SEQ ID NO: 35119 - DNA, 16 bp, Artificial Sequence
  synthetic [barcode part1]
atagtgcctaaccgac

SEQ ID NO: 35120 - DNA, 16 bp, Artificial Sequence
  synthetic [barcode part1]
gaacacgtcaacgacg

SEQ ID NO: 35121 - DNA, 16 bp, Artificial Sequence
  synthetic [barcode part1]
ttgagaagactgcgcg

SEQ ID NO: 35122 - DNA, 16 bp, Artificial Sequence
  synthetic [barcode part1]
caccactctacgtgac

SEQ ID NO: 35123 - DNA, 16 bp, Artificial Sequence
  synthetic [barcode part1]
actcaagacgagtctc

SEQ ID NO: 35124 - DNA, 16 bp, Artificial Sequence
  synthetic [barcode part1]
cgactccgtgtcgatt

SEQ ID NO: 35125 - DNA, 16 bp, Artificial Sequence
  synthetic [barcode part1]
gcgatccgaattatcg

SEQ ID NO: 35126 - DNA, 16 bp, Artificial Sequence
  synthetic [barcode part1]
caagtgttggttcttc

SEQ ID NO: 35127 - DNA, 16 bp, Artificial Sequence
  synthetic [barcode part1]
cgcagtcttaagtacg

SEQ ID NO: 35128 - DNA, 16 bp, Artificial Sequence
  synthetic [barcode part1]
cgtgcaactcggtctt

SEQ ID NO: 35129 - DNA, 16 bp, Artificial Sequence
  synthetic [barcode part1]
gaacactcactattcc

SEQ ID NO: 35130 - DNA, 16 bp, Artificial Sequence
  synthetic [barcode part1]
aggtccgagtggtaac

SEQ ID NO: 35131 - DNA, 16 bp, Artificial Sequence
  synthetic [barcode part1]
ataccttgccagattc

SEQ ID NO: 35132 - DNA, 16 bp, Artificial Sequence
  synthetic [barcode part1]
caagttcttgcagacg

SEQ ID NO: 35133 - DNA, 16 bp, Artificial Sequence
  synthetic [barcode part1]
gccactgagaacacag

SEQ ID NO: 35134 - DNA, 16 bp, Artificial Sequence
  synthetic [barcode part1]
ttatagaggactggac

SEQ ID NO: 35135 - DNA, 16 bp, Artificial Sequence
  synthetic [barcode part1]
aactagaacctagacg

SEQ ID NO: 35136 - DNA, 16 bp, Artificial Sequence
  synthetic [barcode part1]
gcgatactaacaccgt

SEQ ID NO: 35137 - DNA, 16 bp, Artificial Sequence
  synthetic [barcode part1]
cgtctattccgtctgt

SEQ ID NO: 35138 - DNA, 16 bp, Artificial Sequence
  synthetic [barcode part1]
cgttaacttccaactg

SEQ ID NO: 35139 - DNA, 16 bp, Artificial Sequence
  synthetic [barcode part1]
gagaccaattactccg

SEQ ID NO: 35140 - DNA, 16 bp, Artificial Sequence
  synthetic [barcode part1]
acaacgtgttgtgacc

SEQ ID NO: 35141 - DNA, 16 bp, Artificial Sequence
  synthetic [barcode part1]
gcgttctcacaagaac

SEQ ID NO: 35142 - DNA, 16 bp, Artificial Sequence
  synthetic [barcode part1]
cacttcgttatcctgc

SEQ ID NO: 35143 - DNA, 16 bp, Artificial Sequence
  synthetic [barcode part1]
tgcaacacacttatcc

SEQ ID NO: 35144 - DNA, 16 bp, Artificial Sequence
  synthetic [barcode part1]
cggtcagtacgtatac

SEQ ID NO: 35145 - DNA, 16 bp, Artificial Sequence
  synthetic [barcode part1]
ttacgacaggattccg

SEQ ID NO: 35146 - DNA, 16 bp, Artificial Sequence
  synthetic [barcode part1]
cacaagtctcaccgtc

SEQ ID NO: 35147 - DNA, 16 bp, Artificial Sequence
  synthetic [barcode part1]
attcttgtgtcgaacc

SEQ ID NO: 35148 - DNA, 16 bp, Artificial Sequence
  synthetic [barcode part1]
tagtcacttgcacgag

SEQ ID NO: 35149 - DNA, 16 bp, Artificial Sequence
  synthetic [barcode part1]
cgagttaaccgtcaac

SEQ ID NO: 35150 - DNA, 16 bp, Artificial Sequence
  synthetic [barcode part1]
atactctgattaccgc

SEQ ID NO: 35151 - DNA, 16 bp, Artificial Sequence
  synthetic [barcode part1]
gtccaccttgttcact

SEQ ID NO: 35152 - DNA, 16 bp, Artificial Sequence
  synthetic [barcode part1]
gtattccgcacagagt

SEQ ID NO: 35153 - DNA, 16 bp, Artificial Sequence
  synthetic [barcode part1]
tgagactattacggcc

SEQ ID NO: 35154 - DNA, 16 bp, Artificial Sequence
  synthetic [barcode part1]
cagatctatcttaccg

SEQ ID NO: 35155 - DNA, 16 bp, Artificial Sequence
  synthetic [barcode part1]
acaatcggttgcgtac

SEQ ID NO: 35156 - DNA, 16 bp, Artificial Sequence
  synthetic [barcode part1]
aaccgaggcagaatag

SEQ ID NO: 35157 - DNA, 16 bp, Artificial Sequence
  synthetic [barcode part1]
cgcactcaacaattct

SEQ ID NO: 35158 - DNA, 16 bp, Artificial Sequence
  synthetic [barcode part1]
aatctctgaccgtatc

SEQ ID NO: 35159 - DNA, 16 bp, Artificial Sequence
  synthetic [barcode part1]
agaagttccagttccg

SEQ ID NO: 35160 - DNA, 16 bp, Artificial Sequence
  synthetic [barcode part1]
ttcgaacggcggtaag

SEQ ID NO: 35161 - DNA, 16 bp, Artificial Sequence
  synthetic [barcode part1]
tgtggaggacttgacg

SEQ ID NO: 35162 - DNA, 16 bp, Artificial Sequence
  synthetic [barcode part1]
agaagactgagttcgt

SEQ ID NO: 35163 - DNA, 16 bp, Artificial Sequence
  synthetic [barcode part1]
tggaatagacacactg

SEQ ID NO: 35164 - DNA, 16 bp, Artificial Sequence
  synthetic [barcode part1]
cgatcagttggagtct

SEQ ID NO: 35165 - DNA, 16 bp, Artificial Sequence
  synthetic [barcode part1]
acgactatcctccgac

SEQ ID NO: 35166 - DNA, 16 bp, Artificial Sequence
  synthetic [barcode part1]
tcaggagttctcagtg

SEQ ID NO: 35167 - DNA, 16 bp, Artificial Sequence
  synthetic [barcode part1]
aagtaagtcacggtac

SEQ ID NO: 35168 - DNA, 16 bp, Artificial Sequence
  synthetic [barcode part1]
cggtggtcaacaattc

SEQ ID NO: 35169 - DNA, 16 bp, Artificial Sequence
  synthetic [barcode part1]
ccgagaacgtaggttg

SEQ ID NO: 35170 - DNA, 16 bp, Artificial Sequence
  synthetic [barcode part1]
tacgtagtacttcgtc

SEQ ID NO: 35171 - DNA, 16 bp, Artificial Sequence
  synthetic [barcode part1]
tcactattccgaacac

SEQ ID NO: 35172 - DNA, 16 bp, Artificial Sequence
  synthetic [barcode part1]
gtaactaccttctggt

SEQ ID NO: 35173 - DNA, 16 bp, Artificial Sequence
  synthetic [barcode part1]
atccacctatcgcgac

SEQ ID NO: 35174 - DNA, 16 bp, Artificial Sequence
  synthetic [barcode part1]
cgtcaggatccttgtc

SEQ ID NO: 35175 - DNA, 16 bp, Artificial Sequence
  synthetic [barcode part1]
cgtgatacttgtccgc

SEQ ID NO: 35176 - DNA, 16 bp, Artificial Sequence
  synthetic [barcode part1]
tccgactctgattctc

SEQ ID NO: 35177 - DNA, 16 bp, Artificial Sequence
  synthetic [barcode part1]
tgactaggaggttctc

SEQ ID NO: 35178 - DNA, 16 bp, Artificial Sequence
  synthetic [barcode part1]
cctcgcacaataactt

SEQ ID NO: 35179 - DNA, 16 bp, Artificial Sequence
  synthetic [barcode part1]
gtcgagtcaagtcgtt

SEQ ID NO: 35180 - DNA, 16 bp, Artificial Sequence
  synthetic [barcode part1]
gttaggttactggacc

SEQ ID NO: 35181 - DNA, 16 bp, Artificial Sequence
  synthetic [barcode part1]
tagacgtgtgtgatcc

SEQ ID NO: 35182 - DNA, 16 bp, Artificial Sequence
  synthetic [barcode part1]
cgaacaggacagatag

SEQ ID NO: 35183 - DNA, 16 bp, Artificial Sequence
  synthetic [barcode part1]
aggcactgcagtgagt

SEQ ID NO: 35184 - DNA, 16 bp, Artificial Sequence
  synthetic [barcode part1]
taacttcgtgccggtc

SEQ ID NO: 35185 - DNA, 16 bp, Artificial Sequence
  synthetic [barcode part1]
cactctcgtatctctg

SEQ ID NO: 35186 - DNA, 16 bp, Artificial Sequence
  synthetic [barcode part1]
ccagtgccaattacag

SEQ ID NO: 35187 - DNA, 16 bp, Artificial Sequence
  synthetic [barcode part1]
agatcacagtacagac

SEQ ID NO: 35188 - DNA, 16 bp, Artificial Sequence
  synthetic [barcode part1]
tgttcgcggatctcac

SEQ ID NO: 35189 - DNA, 16 bp, Artificial Sequence
  synthetic [barcode part1]
aagttccaaggtcctg

SEQ ID NO: 35190 - DNA, 16 bp, Artificial Sequence
  synthetic [barcode part1]
tgcgtgactcgacctt

SEQ ID NO: 35191 - DNA, 16 bp, Artificial Sequence
  synthetic [barcode part1]
gcgtatagtacacgtc

SEQ ID NO: 35192 - DNA, 16 bp, Artificial Sequence
  synthetic [barcode part1]
tctattcacgataccg

SEQ ID NO: 35193 - DNA, 16 bp, Artificial Sequence
  synthetic [barcode part1]
acagttgtcgacctcc

SEQ ID NO: 35194 - DNA, 16 bp, Artificial Sequence
  synthetic [barcode part1]
cgatcaattcctctcc

SEQ ID NO: 35195 - DNA, 16 bp, Artificial Sequence
  synthetic [barcode part1]
gtccgcctaagattcc

SEQ ID NO: 35196 - DNA, 16 bp, Artificial Sequence
  synthetic [barcode part1]
tctagttgcgttaacc

SEQ ID NO: 35197 - DNA, 16 bp, Artificial Sequence
  synthetic [barcode part1]
tcttgcgatacggaac

SEQ ID NO: 35198 - DNA, 16 bp, Artificial Sequence
  synthetic [barcode part1]
tgagattgcgtcacgt

SEQ ID NO: 35199 - DNA, 16 bp, Artificial Sequence
  synthetic [barcode part1]
ttgtgtgtgcacaacg

SEQ ID NO: 35200 - DNA, 16 bp, Artificial Sequence
  synthetic [barcode part1]
taggtcagactcaacc

SEQ ID NO: 35201 - DNA, 16 bp, Artificial Sequence
  synthetic [barcode part1]
aggacgaagacctgtc

SEQ ID NO: 35202 - DNA, 16 bp, Artificial Sequence
  synthetic [barcode part1]
gacctgattggtggtt

SEQ ID NO: 35203 - DNA, 16 bp, Artificial Sequence
  synthetic [barcode part1]
tgttcgccagatagac

SEQ ID NO: 35204 - DNA, 16 bp, Artificial Sequence
  synthetic [barcode part1]
ttgagaccgtccgttc

SEQ ID NO: 35205 - DNA, 16 bp, Artificial Sequence
  synthetic [barcode part1]
gtcgtcttattcagac

SEQ ID NO: 35206 - DNA, 16 bp, Artificial Sequence
  synthetic [barcode part1]
gatataggacggcctg

SEQ ID NO: 35207 - DNA, 16 bp, Artificial Sequence
  synthetic [barcode part1]
aataagattggcgcgt

SEQ ID NO: 35208 - DNA, 16 bp, Artificial Sequence
  synthetic [barcode part1]
tcggtaatagactgcc

SEQ ID NO: 35209 - DNA, 16 bp, Artificial Sequence
  synthetic [barcode part1]
gacgcaattcacgttg

SEQ ID NO: 35210 - DNA, 16 bp, Artificial Sequence
  synthetic [barcode part1]
tcgcctatccaaggtc

SEQ ID NO: 35211 - DNA, 16 bp, Artificial Sequence
  synthetic [barcode part1]
taggtcgccgaattgt

SEQ ID NO: 35212 - DNA, 16 bp, Artificial Sequence
  synthetic [barcode part1]
ttgcgagacggttact

SEQ ID NO: 35213 - DNA, 16 bp, Artificial Sequence
  synthetic [barcode part1]
gtatcttccaacgatc

SEQ ID NO: 35214 - DNA, 16 bp, Artificial Sequence
  synthetic [barcode part1]
gtcaggtaacgactct

SEQ ID NO: 35215 - DNA, 16 bp, Artificial Sequence
  synthetic [barcode part1]
gtgcaatccgagagac

SEQ ID NO: 35216 - DNA, 16 bp, Artificial Sequence
  synthetic [barcode part1]
cctcacttgaatactg

SEQ ID NO: 35217 - DNA, 16 bp, Artificial Sequence
  synthetic [barcode part1]
ttcttggcgtacaact

SEQ ID NO: 35218 - DNA, 16 bp, Artificial Sequence
  synthetic [barcode part1]
gtactcagtggatctg

SEQ ID NO: 35219 - DNA, 16 bp, Artificial Sequence
  synthetic [barcode part1]
attgagtgagtacggt

SEQ ID NO: 35220 - DNA, 16 bp, Artificial Sequence
  synthetic [barcode part1]
acagaggaagaacacc

SEQ ID NO: 35221 - DNA, 16 bp, Artificial Sequence
  synthetic [barcode part1]
cgttagtcgtgtaacg

SEQ ID NO: 35222 - DNA, 16 bp, Artificial Sequence
  synthetic [barcode part1]
gccacttaacgaagtc

SEQ ID NO: 35223 - DNA, 16 bp, Artificial Sequence
  synthetic [barcode part1]
agtgttggtaccacac

SEQ ID NO: 35224 - DNA, 16 bp, Artificial Sequence
  synthetic [barcode part1]
ttaggcaatagtggac

SEQ ID NO: 35225 - DNA, 16 bp, Artificial Sequence
  synthetic [barcode part1]
gtgttactgttcactg

SEQ ID NO: 35226 - DNA, 16 bp, Artificial Sequence
  synthetic [barcode part1]
aagttatcgccaggtc

SEQ ID NO: 35227 - DNA, 16 bp, Artificial Sequence
  synthetic [barcode part1]
cctgacttgaccgtac

SEQ ID NO: 35228 - DNA, 16 bp, Artificial Sequence
  synthetic [barcode part1]
tgtcgcctctgattct

SEQ ID NO: 35229 - DNA, 16 bp, Artificial Sequence
  synthetic [barcode part1]
tctaactgcactgatc

SEQ ID NO: 35230 - DNA, 16 bp, Artificial Sequence
  synthetic [barcode part1]
cggcgatagaagtgtc

SEQ ID NO: 35231 - DNA, 16 bp, Artificial Sequence
  synthetic [barcode part1]
aactgtgcgcgattac

SEQ ID NO: 35232 - DNA, 16 bp, Artificial Sequence
  synthetic [barcode part1]
gacaaggatacttgac

SEQ ID NO: 35233 - DNA, 16 bp, Artificial Sequence
  synthetic [barcode part1]
aacaggcgatagacag

SEQ ID NO: 35234 - DNA, 16 bp, Artificial Sequence
  synthetic [barcode part1]
ccgcaagattcgaatc

SEQ ID NO: 35235 - DNA, 16 bp, Artificial Sequence
  synthetic [barcode part1]
acgagacacagtagag

SEQ ID NO: 35236 - DNA, 16 bp, Artificial Sequence
  synthetic [barcode part1]
cgtactcctactggac

SEQ ID NO: 35237 - DNA, 16 bp, Artificial Sequence
  synthetic [barcode part1]
tgcaggttggaatagt

SEQ ID NO: 35238 - DNA, 16 bp, Artificial Sequence
  synthetic [barcode part1]
gttatcgttaacggcg

SEQ ID NO: 35239 - DNA, 16 bp, Artificial Sequence
  synthetic [barcode part1]
cctataggcgaatctg

SEQ ID NO: 35240 - DNA, 16 bp, Artificial Sequence
  synthetic [barcode part1]
cgattacaacgcgttg

SEQ ID NO: 35241 - DNA, 16 bp, Artificial Sequence
  synthetic [barcode part1]
cctcaacttctatcgc

SEQ ID NO: 35242 - DNA, 16 bp, Artificial Sequence
  synthetic [barcode part1]
gcagtagtacttcacg

SEQ ID NO: 35243 - DNA, 16 bp, Artificial Sequence
  synthetic [barcode part1]
gtgaaccagaagttgt

SEQ ID NO: 35244 - DNA, 16 bp, Artificial Sequence
  synthetic [barcode part1]
gttgactgacttcgag

SEQ ID NO: 35245 - DNA, 16 bp, Artificial Sequence
  synthetic [barcode part1]
tcgatacaccgtacag

SEQ ID NO: 35246 - DNA, 16 bp, Artificial Sequence
  synthetic [barcode part1]
aggtagaacctcaagt

SEQ ID NO: 35247 - DNA, 16 bp, Artificial Sequence
  synthetic [barcode part1]
atcttatcgccaacgt

SEQ ID NO: 35248 - DNA, 16 bp, Artificial Sequence
  synthetic [barcode part1]
tgatccaggacgcaag

SEQ ID NO: 35249 - DNA, 16 bp, Artificial Sequence
  synthetic [barcode part1]
gcaactgaccaacact

SEQ ID NO: 35250 - DNA, 16 bp, Artificial Sequence
  synthetic [barcode part1]
tgttggttcagttctg

SEQ ID NO: 35251 - DNA, 16 bp, Artificial Sequence
  synthetic [barcode part1]
cacagtgcaagacctt

SEQ ID NO: 35252 - DNA, 16 bp, Artificial Sequence
  synthetic [barcode part1]
accggtgatagaacgc

SEQ ID NO: 35253 - DNA, 16 bp, Artificial Sequence
  synthetic [barcode part1]
tgtggactcgtgagtt

SEQ ID NO: 35254 - DNA, 16 bp, Artificial Sequence
  synthetic [barcode part1]
acaacggtcgttgttg

SEQ ID NO: 35255 - DNA, 16 bp, Artificial Sequence
  synthetic [barcode part1]
attcgtcgagttctgt

SEQ ID NO: 35256 - DNA, 16 bp, Artificial Sequence
  synthetic [barcode part1]
cgaccttaacttcctc

SEQ ID NO: 35257 - DNA, 16 bp, Artificial Sequence
  synthetic [barcode part1]
ttggagttgaggttcc

SEQ ID NO: 35258 - DNA, 16 bp, Artificial Sequence
  synthetic [barcode part1]
tgtgtctcgttagact

SEQ ID NO: 35259 - DNA, 16 bp, Artificial Sequence
  synthetic [barcode part1]
ttgttgtctcggatac

SEQ ID NO: 35260 - DNA, 16 bp, Artificial Sequence
  synthetic [barcode part1]
gcgatattgacactgc

SEQ ID NO: 35261 - DNA, 16 bp, Artificial Sequence
  synthetic [barcode part1]
acctcgtaagtgcctc

SEQ ID NO: 35262 - DNA, 16 bp, Artificial Sequence
  synthetic [barcode part1]
ataaccgtaacgcgtc

SEQ ID NO: 35263 - DNA, 16 bp, Artificial Sequence
  synthetic [barcode part1]
gaactgtctcaacgac

SEQ ID NO: 35264 - DNA, 16 bp, Artificial Sequence
  synthetic [barcode part1]
tgacaggatcctactg

SEQ ID NO: 35265 - DNA, 16 bp, Artificial Sequence
  synthetic [barcode part1]
tggattcgagtgatag

SEQ ID NO: 35266 - DNA, 16 bp, Artificial Sequence
  synthetic [barcode part1]
ataactgcctcgactt

SEQ ID NO: 35267 - DNA, 16 bp, Artificial Sequence
  synthetic [barcode part1]
tgtagaatacgcctcg

SEQ ID NO: 35268 - DNA, 16 bp, Artificial Sequence
  synthetic [barcode part1]
acactccgttgagtcc

SEQ ID NO: 35269 - DNA, 16 bp, Artificial Sequence
  synthetic [barcode part1]
accactcgcgaattcc

SEQ ID NO: 35270 - DNA, 16 bp, Artificial Sequence
  synthetic [barcode part1]
gccaatatctaacctc

SEQ ID NO: 35271 - DNA, 16 bp, Artificial Sequence
  synthetic [barcode part1]
gacacacttaactcct

SEQ ID NO: 35272 - DNA, 16 bp, Artificial Sequence
  synthetic [barcode part1]
acacctcacacaagac

SEQ ID NO: 35273 - DNA, 16 bp, Artificial Sequence
  synthetic [barcode part1]
acacttgtgaacaccg

SEQ ID NO: 35274 - DNA, 16 bp, Artificial Sequence
  synthetic [barcode part1]
aaggcctacttcaggt

SEQ ID NO: 35275 - DNA, 16 bp, Artificial Sequence
  synthetic [barcode part1]
gtctcctgcgtactag

SEQ ID NO: 35276 - DNA, 16 bp, Artificial Sequence
  synthetic [barcode part1]
taccacacaactgacg

SEQ ID NO: 35277 - DNA, 16 bp, Artificial Sequence
  synthetic [barcode part1]
tacctcgataagttcc

SEQ ID NO: 35278 - DNA, 16 bp, Artificial Sequence
  synthetic [barcode part1]
acagtaccagtaccac

SEQ ID NO: 35279 - DNA, 16 bp, Artificial Sequence
  synthetic [barcode part1]
ataggcctggtggagt

SEQ ID NO: 35280 - DNA, 16 bp, Artificial Sequence
  synthetic [barcode part1]
atcgcaggtaacacct

SEQ ID NO: 35281 - DNA, 16 bp, Artificial Sequence
  synthetic [barcode part1]
gacgactaaccgttgt

SEQ ID NO: 35282 - DNA, 16 bp, Artificial Sequence
  synthetic [barcode part1]
ccaagtaggtgtctac

SEQ ID NO: 35283 - DNA, 16 bp, Artificial Sequence
  synthetic [barcode part1]
ttggatctcttacacg

SEQ ID NO: 35284 - DNA, 16 bp, Artificial Sequence
  synthetic [barcode part1]
tagttcgtgaactgcg

SEQ ID NO: 35285 - DNA, 16 bp, Artificial Sequence
  synthetic [barcode part1]
gccaaccgtactatag

SEQ ID NO: 35286 - DNA, 16 bp, Artificial Sequence
  synthetic [barcode part1]
gtggttatcctaatcc

SEQ ID NO: 35287 - DNA, 16 bp, Artificial Sequence
  synthetic [barcode part1]
ttcggttggttgaggt

SEQ ID NO: 35288 - DNA, 16 bp, Artificial Sequence
  synthetic [barcode part1]
gtcgcctcagaatagt

SEQ ID NO: 35289 - DNA, 16 bp, Artificial Sequence
  synthetic [barcode part1]
tatacttagaccgcct

SEQ ID NO: 35290 - DNA, 16 bp, Artificial Sequence
  synthetic [barcode part1]
tgccggatattagacc

SEQ ID NO: 35291 - DNA, 16 bp, Artificial Sequence
  synthetic [barcode part1]
cctaacactcacaccg

SEQ ID NO: 35292 - DNA, 16 bp, Artificial Sequence
  synthetic [barcode part1]
aggtcttcacaacacg

SEQ ID NO: 35293 - DNA, 16 bp, Artificial Sequence
  synthetic [barcode part1]
tactggaagtggtctc

SEQ ID NO: 35294 - DNA, 16 bp, Artificial Sequence
  synthetic [barcode part1]
aacaccttcgtgtgag

SEQ ID NO: 35295 - DNA, 16 bp, Artificial Sequence
  synthetic [barcode part1]
ccggaatcctaggatt

SEQ ID NO: 35296 - DNA, 16 bp, Artificial Sequence
  synthetic [barcode part1]
ttgaggcgacgttgtt

SEQ ID NO: 35297 - DNA, 16 bp, Artificial Sequence
  synthetic [barcode part1]
atactggcgaccttcc

SEQ ID NO: 35298 - DNA, 16 bp, Artificial Sequence
  synthetic [barcode part1]
atccaagttaccttgc

SEQ ID NO: 35299 - DNA, 16 bp, Artificial Sequence
  synthetic [barcode part1]
cctcacggattcaatt

SEQ ID NO: 35300 - DNA, 16 bp, Artificial Sequence
  synthetic [barcode part1]
tctaacggagtacaag

SEQ ID NO: 35301 - DNA, 16 bp, Artificial Sequence
  synthetic [barcode part1]
agactacgcagtctac

SEQ ID NO: 35302 - DNA, 16 bp, Artificial Sequence
  synthetic [barcode part1]
aaccaaccacaacacc

SEQ ID NO: 35303 - DNA, 16 bp, Artificial Sequence
  synthetic [barcode part1]
cctattactgatacgc

SEQ ID NO: 35304 - DNA, 16 bp, Artificial Sequence
  synthetic [barcode part1]
gaggactagaactgag

SEQ ID NO: 35305 - DNA, 16 bp, Artificial Sequence
  synthetic [barcode part1]
attcttcaccgacgcg

SEQ ID NO: 35306 - DNA, 16 bp, Artificial Sequence
  synthetic [barcode part1]
gaggtgaaggtgatac

SEQ ID NO: 35307 - DNA, 16 bp, Artificial Sequence
  synthetic [barcode part1]
tgtgtactgcagtacg

SEQ ID NO: 35308 - DNA, 16 bp, Artificial Sequence
  synthetic [barcode part1]
tcggtggaagttactc

SEQ ID NO: 35309 - DNA, 16 bp, Artificial Sequence
  synthetic [barcode part1]
tccacactacgaagac

SEQ ID NO: 35310 - DNA, 16 bp, Artificial Sequence
  synthetic [barcode part1]
taggtctcgaggcaag

SEQ ID NO: 35311 - DNA, 16 bp, Artificial Sequence
  synthetic [barcode part1]
agagtctcttgaggtc

SEQ ID NO: 35312 - DNA, 16 bp, Artificial Sequence
  synthetic [barcode part1]
tccacaagtaacagag

SEQ ID NO: 35313 - DNA, 16 bp, Artificial Sequence
  synthetic [barcode part1]
ataggaacgtgaaggc

SEQ ID NO: 35314 - DNA, 16 bp, Artificial Sequence
  synthetic [barcode part1]
cgcgtggttatacagt

SEQ ID NO: 35315 - DNA, 16 bp, Artificial Sequence
  synthetic [barcode part1]
aaccacaacgtgtcac

SEQ ID NO: 35316 - DNA, 16 bp, Artificial Sequence
  synthetic [barcode part1]
gaatcaagaccgagag

SEQ ID NO: 35317 - DNA, 16 bp, Artificial Sequence
  synthetic [barcode part1]
ttcgagtatctaggcg

SEQ ID NO: 35318 - DNA, 16 bp, Artificial Sequence
  synthetic [barcode part1]
aagtggatctaggact

SEQ ID NO: 35319 - DNA, 16 bp, Artificial Sequence
  synthetic [barcode part1]
ttgcgtacgatacgtg

SEQ ID NO: 35320 - DNA, 16 bp, Artificial Sequence
  synthetic [barcode part1]
tgcgcgaacaactatc

SEQ ID NO: 35321 - DNA, 16 bp, Artificial Sequence
  synthetic [barcode part1]
ttgcagacctggttcc

SEQ ID NO: 35322 - DNA, 16 bp, Artificial Sequence
  synthetic [barcode part1]
cgtgaagtcaataacg

SEQ ID NO: 35323 - DNA, 16 bp, Artificial Sequence
  synthetic [barcode part1]
gcgattagatcaagac

SEQ ID NO: 35324 - DNA, 16 bp, Artificial Sequence
  synthetic [barcode part1]
taagtcaacacctcct

SEQ ID NO: 35325 - DNA, 16 bp, Artificial Sequence
  synthetic [barcode part1]
gtggaaccttattgcg

SEQ ID NO: 35326 - DNA, 16 bp, Artificial Sequence
  synthetic [barcode part1]
ttacactccgcacttc

SEQ ID NO: 35327 - DNA, 16 bp, Artificial Sequence
  synthetic [barcode part1]
tctaccaggagtggtt

SEQ ID NO: 35328 - DNA, 16 bp, Artificial Sequence
  synthetic [barcode part1]
cgacgtctacttaccg

SEQ ID NO: 35329 - DNA, 16 bp, Artificial Sequence
  synthetic [barcode part1]
attcactctgtagtgc

SEQ ID NO: 35330 - DNA, 16 bp, Artificial Sequence
  synthetic [barcode part1]
acacacagtgtgtgtc

SEQ ID NO: 35331 - DNA, 16 bp, Artificial Sequence
  synthetic [barcode part1]
gcaagttgtgcagttc

SEQ ID NO: 35332 - DNA, 16 bp, Artificial Sequence
  synthetic [barcode part1]
gtccttcgtatatcag

SEQ ID NO: 35333 - DNA, 16 bp, Artificial Sequence
  synthetic [barcode part1]
atcagtcttctcctcg

SEQ ID NO: 35334 - DNA, 16 bp, Artificial Sequence
  synthetic [barcode part1]
tcctattggcacttag

SEQ ID NO: 35335 - DNA, 16 bp, Artificial Sequence
  synthetic [barcode part1]
cggattaagtcactgc

SEQ ID NO: 35336 - DNA, 16 bp, Artificial Sequence
  synthetic [barcode part1]
cgtagttaggaactag

SEQ ID NO: 35337 - DNA, 16 bp, Artificial Sequence
  synthetic [barcode part1]
accgagattccttgag

SEQ ID NO: 35338 - DNA, 16 bp, Artificial Sequence
  synthetic [barcode part1]
cctagaggtatcacgt

SEQ ID NO: 35339 - DNA, 16 bp, Artificial Sequence
  synthetic [barcode part1]
tggatcggaggtgtgt

SEQ ID NO: 35340 - DNA, 16 bp, Artificial Sequence
  synthetic [barcode part1]
cgcgtgacttagttcc

SEQ ID NO: 35341 - DNA, 16 bp, Artificial Sequence
  synthetic [barcode part1]
acacagttggtacgtc

SEQ ID NO: 35342 - DNA, 16 bp, Artificial Sequence
  synthetic [barcode part1]
agtcactcttgtgttg

SEQ ID NO: 35343 - DNA, 16 bp, Artificial Sequence
  synthetic [barcode part1]
cgaactgagtctggtt

SEQ ID NO: 35344 - DNA, 16 bp, Artificial Sequence
  synthetic [barcode part1]
cacttactgccacggt

SEQ ID NO: 35345 - DNA, 16 bp, Artificial Sequence
  synthetic [barcode part1]
cacctgtagatcttac

SEQ ID NO: 35346 - DNA, 16 bp, Artificial Sequence
  synthetic [barcode part1]
gtctcgttgaacttac

SEQ ID NO: 35347 - DNA, 16 bp, Artificial Sequence
  synthetic [barcode part1]
cgtacgaagacgttct

SEQ ID NO: 35348 - DNA, 16 bp, Artificial Sequence
  synthetic [barcode part1]
cacctcttagtccgag

SEQ ID NO: 35349 - DNA, 16 bp, Artificial Sequence
  synthetic [barcode part1]
gaacctagttcaggtc

SEQ ID NO: 35350 - DNA, 16 bp, Artificial Sequence
  synthetic [barcode part1]
tggtggagaacctacg

SEQ ID NO: 35351 - DNA, 16 bp, Artificial Sequence
  synthetic [barcode part1]
attccgaattgtggcg

SEQ ID NO: 35352 - DNA, 16 bp, Artificial Sequence
  synthetic [barcode part1]
ccgcgagtagaaggtt

SEQ ID NO: 35353 - DNA, 16 bp, Artificial Sequence
  synthetic [barcode part1]
atactggtgcgttgac

SEQ ID NO: 35354 - DNA, 16 bp, Artificial Sequence
  synthetic [barcode part1]
gagactgtgcagactg

SEQ ID NO: 35355 - DNA, 16 bp, Artificial Sequence
  synthetic [barcode part1]
ttgagacagactccac

SEQ ID NO: 35356 - DNA, 16 bp, Artificial Sequence
  synthetic [barcode part1]
tgtcacaaccacaacg

SEQ ID NO: 35357 - DNA, 16 bp, Artificial Sequence
  synthetic [barcode part1]
agagtaacggatactc

SEQ ID NO: 35358 - DNA, 16 bp, Artificial Sequence
  synthetic [barcode part1]
ttcagaaccggagtct

SEQ ID NO: 35359 - DNA, 16 bp, Artificial Sequence
  synthetic [barcode part1]
ttaaccgataccgcag

SEQ ID NO: 35360 - DNA, 16 bp, Artificial Sequence
  synthetic [barcode part1]
aacggaaccgacgtgt

SEQ ID NO: 35361 - DNA, 16 bp, Artificial Sequence
  synthetic [barcode part1]
agatctgtctgtaggc

SEQ ID NO: 35362 - DNA, 16 bp, Artificial Sequence
  synthetic [barcode part1]
gtgtgcaagtctcagt

SEQ ID NO: 35363 - DNA, 16 bp, Artificial Sequence
  synthetic [barcode part1]
caacggagtggacttg

SEQ ID NO: 35364 - DNA, 16 bp, Artificial Sequence
  synthetic [barcode part1]
agacgccttatcctgc

SEQ ID NO: 35365 - DNA, 16 bp, Artificial Sequence
  synthetic [barcode part1]
acgatcaaccgtacac

SEQ ID NO: 35366 - DNA, 16 bp, Artificial Sequence
  synthetic [barcode part1]
tgatataagtcgcgcc

SEQ ID NO: 35367 - DNA, 16 bp, Artificial Sequence
  synthetic [barcode part1]
tccggagtggtattac

SEQ ID NO: 35368 - DNA, 16 bp, Artificial Sequence
  synthetic [barcode part1]
cctgaagttcctctct

SEQ ID NO: 35369 - DNA, 16 bp, Artificial Sequence
  synthetic [barcode part1]
accagtaagtacgtcc

SEQ ID NO: 35370 - DNA, 16 bp, Artificial Sequence
  synthetic [barcode part1]
agtacactgacgtacc

SEQ ID NO: 35371 - DNA, 16 bp, Artificial Sequence
  synthetic [barcode part1]
gtcctcagataatctc

SEQ ID NO: 35372 - DNA, 16 bp, Artificial Sequence
  synthetic [barcode part1]
aattggcaggatcctc

SEQ ID NO: 35373 - DNA, 16 bp, Artificial Sequence
  synthetic [barcode part1]
ccgtgcaagaagatcg

SEQ ID NO: 35374 - DNA, 16 bp, Artificial Sequence
  synthetic [barcode part1]
ccgtaggacttgaatc

SEQ ID NO: 35375 - DNA, 16 bp, Artificial Sequence
  synthetic [barcode part1]
aacgtcgtctccttct

SEQ ID NO: 35376 - DNA, 16 bp, Artificial Sequence
  synthetic [barcode part1]
tcggcaaggcgtaagt

SEQ ID NO: 35377 - DNA, 16 bp, Artificial Sequence
  synthetic [barcode part1]
cgaatacaccgccttc

SEQ ID NO: 35378 - DNA, 16 bp, Artificial Sequence
  synthetic [barcode part1]
tacgttccgagagtgt

SEQ ID NO: 35379 - DNA, 16 bp, Artificial Sequence
  synthetic [barcode part1]
atcggagactgacgtg

SEQ ID NO: 35380 - DNA, 16 bp, Artificial Sequence
  synthetic [barcode part1]
gtgaactcgacaggac

SEQ ID NO: 35381 - DNA, 16 bp, Artificial Sequence
  synthetic [barcode part1]
actctaccgttccgtt

SEQ ID NO: 35382 - DNA, 16 bp, Artificial Sequence
  synthetic [barcode part1]
gtgattacggcacact

SEQ ID NO: 35383 - DNA, 16 bp, Artificial Sequence
  synthetic [barcode part1]
aatccgtggataacag

SEQ ID NO: 35384 - DNA, 16 bp, Artificial Sequence
  synthetic [barcode part1]
tgtgcgcaccaattag

SEQ ID NO: 35385 - DNA, 16 bp, Artificial Sequence
  synthetic [barcode part1]
tcgtggaggtaacggt

SEQ ID NO: 35386 - DNA, 16 bp, Artificial Sequence
  synthetic [barcode part1]
aatccggaattgccgt

SEQ ID NO: 35387 - DNA, 16 bp, Artificial Sequence
  synthetic [barcode part1]
acgaggtagtgcctag

SEQ ID NO: 35388 - DNA, 16 bp, Artificial Sequence
  synthetic [barcode part1]
cgagtataaggtggcc

SEQ ID NO: 35389 - DNA, 16 bp, Artificial Sequence
  synthetic [barcode part1]
ccgtgtcagtagtcct

SEQ ID NO: 35390 - DNA, 16 bp, Artificial Sequence
  synthetic [barcode part1]
tcggttctcacgcaac

SEQ ID NO: 35391 - DNA, 16 bp, Artificial Sequence
  synthetic [barcode part1]
acgaaggaatctagtc

SEQ ID NO: 35392 - DNA, 16 bp, Artificial Sequence
  synthetic [barcode part1]
tcgttgttccgtcact

SEQ ID NO: 35393 - DNA, 16 bp, Artificial Sequence
  synthetic [barcode part1]
cctgacgtaagaatag

SEQ ID NO: 35394 - DNA, 16 bp, Artificial Sequence
  synthetic [barcode part1]
tctaacgtggaagtag

SEQ ID NO: 35395 - DNA, 16 bp, Artificial Sequence
  synthetic [barcode part1]
ttggtggtattcctgt

SEQ ID NO: 35396 - DNA, 16 bp, Artificial Sequence
  synthetic [barcode part1]
cgaacgaatctacctg

SEQ ID NO: 35397 - DNA, 16 bp, Artificial Sequence
  synthetic [barcode part1]
caatctctctctcggt

SEQ ID NO: 35398 - DNA, 16 bp, Artificial Sequence
  synthetic [barcode part1]
tctgatcaccacgcgt

SEQ ID NO: 35399 - DNA, 16 bp, Artificial Sequence
  synthetic [barcode part1]
gattagagacggcaag

SEQ ID NO: 35400 - DNA, 16 bp, Artificial Sequence
  synthetic [barcode part1]
ttactgttgtcgcctc

SEQ ID NO: 35401 - DNA, 16 bp, Artificial Sequence
  synthetic [barcode part1]
attctaccaggagacc

SEQ ID NO: 35402 - DNA, 16 bp, Artificial Sequence
  synthetic [barcode part1]
atcacctgatacctgt

SEQ ID NO: 35403 - DNA, 16 bp, Artificial Sequence
  synthetic [barcode part1]
tgccaaggagtgcagt

SEQ ID NO: 35404 - DNA, 16 bp, Artificial Sequence
  synthetic [barcode part1]
gaattgtccgtatcct

SEQ ID NO: 35405 - DNA, 16 bp, Artificial Sequence
  synthetic [barcode part1]
tcagtcagttgtggtg

SEQ ID NO: 35406 - DNA, 16 bp, Artificial Sequence
  synthetic [barcode part1]
cctactacacgttagt

SEQ ID NO: 35407 - DNA, 16 bp, Artificial Sequence
  synthetic [barcode part1]
taattccgcgtattgc

SEQ ID NO: 35408 - DNA, 16 bp, Artificial Sequence
  synthetic [barcode part1]
gttatctgaactcgtc

SEQ ID NO: 35409 - DNA, 16 bp, Artificial Sequence
  synthetic [barcode part1]
gtacggttgcgtaact

SEQ ID NO: 35410 - DNA, 16 bp, Artificial Sequence
  synthetic [barcode part1]
tctgttgtacgagtct

SEQ ID NO: 35411 - DNA, 16 bp, Artificial Sequence
  synthetic [barcode part1]
acttcgtgttcggatt

SEQ ID NO: 35412 - DNA, 16 bp, Artificial Sequence
  synthetic [barcode part1]
aattaacgtcgcgacc

SEQ ID NO: 35413 - DNA, 16 bp, Artificial Sequence
  synthetic [barcode part1]
agagtaagaattcgcc

SEQ ID NO: 35414 - DNA, 16 bp, Artificial Sequence
  synthetic [barcode part1]
tacgtaccaacgtcag

SEQ ID NO: 35415 - DNA, 16 bp, Artificial Sequence
  synthetic [barcode part1]
tggaggaaccggtatc

SEQ ID NO: 35416 - DNA, 16 bp, Artificial Sequence
  synthetic [barcode part1]
acgaacgcagaacctg

SEQ ID NO: 35417 - DNA, 16 bp, Artificial Sequence
  synthetic [barcode part1]
ccgtgcactccaattg

SEQ ID NO: 35418 - DNA, 16 bp, Artificial Sequence
  synthetic [barcode part1]
gtagaatacggcagag

SEQ ID NO: 35419 - DNA, 16 bp, Artificial Sequence
  synthetic [barcode part1]
tgttgagttacgtctc

SEQ ID NO: 35420 - DNA, 16 bp, Artificial Sequence
  synthetic [barcode part1]
atagtaccaacgccgt

SEQ ID NO: 35421 - DNA, 16 bp, Artificial Sequence
  synthetic [barcode part1]
gaatctagacagtggt

SEQ ID NO: 35422 - DNA, 16 bp, Artificial Sequence
  synthetic [barcode part1]
agtactctagaagacg

SEQ ID NO: 35423 - DNA, 16 bp, Artificial Sequence
  synthetic [barcode part1]
ccgtccgaatattatc

SEQ ID NO: 35424 - DNA, 16 bp, Artificial Sequence
  synthetic [barcode part1]
gatatccgtcttctag

SEQ ID NO: 35425 - DNA, 16 bp, Artificial Sequence
  synthetic [barcode part1]
acaggccgtcaagaac

SEQ ID NO: 35426 - DNA, 16 bp, Artificial Sequence
  synthetic [barcode part1]
atagagacaatctggc

SEQ ID NO: 35427 - DNA, 16 bp, Artificial Sequence
  synthetic [barcode part1]
tcactccaattgcgcg

SEQ ID NO: 35428 - DNA, 16 bp, Artificial Sequence
  synthetic [barcode part1]
actcaccaacgttatc

SEQ ID NO: 35429 - DNA, 16 bp, Artificial Sequence
  synthetic [barcode part1]
aactctgaagtgaacg

SEQ ID NO: 35430 - DNA, 16 bp, Artificial Sequence
  synthetic [barcode part1]
gtgtggcctaaggaac

SEQ ID NO: 35431 - DNA, 16 bp, Artificial Sequence
  synthetic [barcode part1]
gacggttgtgtgaggt

SEQ ID NO: 35432 - DNA, 16 bp, Artificial Sequence
  synthetic [barcode part1]
tcagtacacgtaccag

SEQ ID NO: 35433 - DNA, 16 bp, Artificial Sequence
  synthetic [barcode part1]
tgattcgacggtctag

SEQ ID NO: 35434 - DNA, 16 bp, Artificial Sequence
  synthetic [barcode part1]
cgaccacttgtgtaag

SEQ ID NO: 35435 - DNA, 16 bp, Artificial Sequence
  synthetic [barcode part1]
tccgttgagtctgtgc

SEQ ID NO: 35436 - DNA, 16 bp, Artificial Sequence
  synthetic [barcode part1]
tgactctataccgact

SEQ ID NO: 35437 - DNA, 16 bp, Artificial Sequence
  synthetic [barcode part1]
taactcgacgaaggcg

SEQ ID NO: 35438 - DNA, 16 bp, Artificial Sequence
  synthetic [barcode part1]
tcaacacgccgtatag

SEQ ID NO: 35439 - DNA, 16 bp, Artificial Sequence
  synthetic [barcode part1]
gtcttaggcgtatacg

SEQ ID NO: 35440 - DNA, 16 bp, Artificial Sequence
  synthetic [barcode part1]
gttaccaacgtcctcg

SEQ ID NO: 35441 - DNA, 16 bp, Artificial Sequence
  synthetic [barcode part1]
tctgttacggtctctc

SEQ ID NO: 35442 - DNA, 16 bp, Artificial Sequence
  synthetic [barcode part1]
agacggaatcctggac

SEQ ID NO: 35443 - DNA, 16 bp, Artificial Sequence
  synthetic [barcode part1]
ataccgaaggaattgc

SEQ ID NO: 35444 - DNA, 16 bp, Artificial Sequence
  synthetic [barcode part1]
cagtaacgtataggac

SEQ ID NO: 35445 - DNA, 16 bp, Artificial Sequence
  synthetic [barcode part1]
tggacacacgtaacct

SEQ ID NO: 35446 - DNA, 16 bp, Artificial Sequence
  synthetic [barcode part1]
acacttgcctatcgcg

SEQ ID NO: 35447 - DNA, 16 bp, Artificial Sequence
  synthetic [barcode part1]
atccggaaggcctatt

SEQ ID NO: 35448 - DNA, 16 bp, Artificial Sequence
  synthetic [barcode part1]
taggatcactgcagtc

SEQ ID NO: 35449 - DNA, 16 bp, Artificial Sequence
  synthetic [barcode part1]
cagtacggtcactcct

SEQ ID NO: 35450 - DNA, 16 bp, Artificial Sequence
  synthetic [barcode part1]
agtgtaagaatcgtcg

SEQ ID NO: 35451 - DNA, 16 bp, Artificial Sequence
  synthetic [barcode part1]
gtgtacgttaaccggt

SEQ ID NO: 35452 - DNA, 16 bp, Artificial Sequence
  synthetic [barcode part1]
aataaccgccgttggt

SEQ ID NO: 35453 - DNA, 16 bp, Artificial Sequence
  synthetic [barcode part1]
actgccttacttgaac

SEQ ID NO: 35454 - DNA, 16 bp, Artificial Sequence
  synthetic [barcode part1]
tgagaccaaggaaggt

SEQ ID NO: 35455 - DNA, 16 bp, Artificial Sequence
  synthetic [barcode part1]
tactggttggtgtgtg

SEQ ID NO: 35456 - DNA, 16 bp, Artificial Sequence
  synthetic [barcode part1]
gttgtgtatcgtcttg

SEQ ID NO: 35457 - DNA, 16 bp, Artificial Sequence
  synthetic [barcode part1]
tcttacgtggtgactt

SEQ ID NO: 35458 - DNA, 16 bp, Artificial Sequence
  synthetic [barcode part1]
caacactgatagacag

SEQ ID NO: 35459 - DNA, 16 bp, Artificial Sequence
  synthetic [barcode part1]
ccttctcagttgacct

SEQ ID NO: 35460 - DNA, 16 bp, Artificial Sequence
  synthetic [barcode part1]
ttgatcctattggcgt

SEQ ID NO: 35461 - DNA, 16 bp, Artificial Sequence
  synthetic [barcode part1]
ccaacttcgtctcgtt

SEQ ID NO: 35462 - DNA, 16 bp, Artificial Sequence
  synthetic [barcode part1]
gcctctgacaagaact

SEQ ID NO: 35463 - DNA, 16 bp, Artificial Sequence
  synthetic [barcode part1]
tactcacgtctgtcct

SEQ ID NO: 35464 - DNA, 16 bp, Artificial Sequence
  synthetic [barcode part1]
ttcgacaccgttagag

SEQ ID NO: 35465 - DNA, 16 bp, Artificial Sequence
  synthetic [barcode part1]
cacctcgcgaacactt

SEQ ID NO: 35466 - DNA, 16 bp, Artificial Sequence
  synthetic [barcode part1]
cagttagttgaccgac

SEQ ID NO: 35467 - DNA, 16 bp, Artificial Sequence
  synthetic [barcode part1]
aagtcgtaacacgaac

SEQ ID NO: 35468 - DNA, 16 bp, Artificial Sequence
  synthetic [barcode part1]
taattggcgcgtgtgt

SEQ ID NO: 35469 - DNA, 16 bp, Artificial Sequence
  synthetic [barcode part1]
tcggtaacactaggtc

SEQ ID NO: 35470 - DNA, 16 bp, Artificial Sequence
  synthetic [barcode part1]
taaggaaccgaaggac

SEQ ID NO: 35471 - DNA, 16 bp, Artificial Sequence
  synthetic [barcode part1]
cctcaactacggatcc

SEQ ID NO: 35472 - DNA, 16 bp, Artificial Sequence
  synthetic [barcode part1]
ttaagagtggcctctg

SEQ ID NO: 35473 - DNA, 16 bp, Artificial Sequence
  synthetic [barcode part1]
gttcgtatcaggtgtg

SEQ ID NO: 35474 - DNA, 16 bp, Artificial Sequence
  synthetic [barcode part1]
ccggaattcacttact

SEQ ID NO: 35475 - DNA, 16 bp, Artificial Sequence
  synthetic [barcode part1]
tagacgtagaacaacc

SEQ ID NO: 35476 - DNA, 16 bp, Artificial Sequence
  synthetic [barcode part1]
ataactgccggttctt

SEQ ID NO: 35477 - DNA, 16 bp, Artificial Sequence
  synthetic [barcode part1]
actatctggatctgtc

SEQ ID NO: 35478 - DNA, 16 bp, Artificial Sequence
  synthetic [barcode part1]
aaccgattggtatcgc

SEQ ID NO: 35479 - DNA, 16 bp, Artificial Sequence
  synthetic [barcode part1]
tcgtcctaaggtaacg

SEQ ID NO: 35480 - DNA, 16 bp, Artificial Sequence
  synthetic [barcode part1]
accgttaatcagaccg

SEQ ID NO: 35481 - DNA, 16 bp, Artificial Sequence
  synthetic [barcode part1]
ccttcctaatctcggt

SEQ ID NO: 35482 - DNA, 16 bp, Artificial Sequence
  synthetic [barcode part1]
tgaacaagtggtgccg

SEQ ID NO: 35483 - DNA, 16 bp, Artificial Sequence
  synthetic [barcode part1]
gttgaggattacgtag

SEQ ID NO: 35484 - DNA, 16 bp, Artificial Sequence
  synthetic [barcode part1]
gtgcaatcgactgtac

SEQ ID NO: 35485 - DNA, 16 bp, Artificial Sequence
  synthetic [barcode part1]
gaggaatctacgtagt

SEQ ID NO: 35486 - DNA, 16 bp, Artificial Sequence
  synthetic [barcode part1]
cgagatcagaaggagt

SEQ ID NO: 35487 - DNA, 16 bp, Artificial Sequence
  synthetic [barcode part1]
agattcgttcgtaggc

SEQ ID NO: 35488 - DNA, 16 bp, Artificial Sequence
  synthetic [barcode part1]
taagtgtagtccgcgt

SEQ ID NO: 35489 - DNA, 16 bp, Artificial Sequence
  synthetic [barcode part1]
cactgaggagtcactt

SEQ ID NO: 35490 - DNA, 16 bp, Artificial Sequence
  synthetic [barcode part1]
tgcgcagtccaacttc

SEQ ID NO: 35491 - DNA, 16 bp, Artificial Sequence
  synthetic [barcode part1]
taacgtggagacggtc

SEQ ID NO: 35492 - DNA, 16 bp, Artificial Sequence
  synthetic [barcode part1]
cggtgaatagagtgag

SEQ ID NO: 35493 - DNA, 16 bp, Artificial Sequence
  synthetic [barcode part1]
cggtgtactctattgt

SEQ ID NO: 35494 - DNA, 16 bp, Artificial Sequence
  synthetic [barcode part1]
gtgttcctaacctaac

SEQ ID NO: 35495 - DNA, 16 bp, Artificial Sequence
  synthetic [barcode part1]
gactcgcctattccag

SEQ ID NO: 35496 - DNA, 16 bp, Artificial Sequence
  synthetic [barcode part1]
gaccgtaccaattctt

SEQ ID NO: 35497 - DNA, 16 bp, Artificial Sequence
  synthetic [barcode part1]
atctcgaattacggcg

SEQ ID NO: 35498 - DNA, 16 bp, Artificial Sequence
  synthetic [barcode part1]
tactgccgcaactacc

SEQ ID NO: 35499 - DNA, 16 bp, Artificial Sequence
  synthetic [barcode part1]
tgaccagtacacacgt

SEQ ID NO: 35500 - DNA, 16 bp, Artificial Sequence
  synthetic [barcode part1]
ccacgtggaagtcaag

SEQ ID NO: 35501 - DNA, 16 bp, Artificial Sequence
  synthetic [barcode part1]
acggaacacgaatccg

SEQ ID NO: 35502 - DNA, 16 bp, Artificial Sequence
  synthetic [barcode part1]
tcttcgccaagagtag

SEQ ID NO: 35503 - DNA, 16 bp, Artificial Sequence
  synthetic [barcode part1]
agtctgtgtctcaccg

SEQ ID NO: 35504 - DNA, 16 bp, Artificial Sequence
  synthetic [barcode part1]
tcgtccttagttcctg

SEQ ID NO: 35505 - DNA, 16 bp, Artificial Sequence
  synthetic [barcode part1]
tgatacgcagtaagac

SEQ ID NO: 35506 - DNA, 16 bp, Artificial Sequence
  synthetic [barcode part1]
cgccagaattcttatc

SEQ ID NO: 35507 - DNA, 16 bp, Artificial Sequence
  synthetic [barcode part1]
gccaattcgataccag

SEQ ID NO: 35508 - DNA, 16 bp, Artificial Sequence
  synthetic [barcode part1]
actcttgcactggatt

SEQ ID NO: 35509 - DNA, 16 bp, Artificial Sequence
  synthetic [barcode part1]
ttgattctaggcctac

SEQ ID NO: 35510 - DNA, 16 bp, Artificial Sequence
  synthetic [barcode part1]
tattgcctggacttgt

SEQ ID NO: 35511 - DNA, 16 bp, Artificial Sequence
  synthetic [barcode part1]
gattgaagatacaccg

SEQ ID NO: 35512 - DNA, 16 bp, Artificial Sequence
  synthetic [barcode part1]
ttacttggcagtgttc

SEQ ID NO: 35513 - DNA, 16 bp, Artificial Sequence
  synthetic [barcode part1]
atcttgtacgactacc

SEQ ID NO: 35514 - DNA, 16 bp, Artificial Sequence
  synthetic [barcode part1]
cgttgcgttaggattg

SEQ ID NO: 35515 - DNA, 16 bp, Artificial Sequence
  synthetic [barcode part1]
tgactgatacgtgtgc

SEQ ID NO: 35516 - DNA, 16 bp, Artificial Sequence
  synthetic [barcode part1]
tacgtgaggattagac

SEQ ID NO: 35517 - DNA, 16 bp, Artificial Sequence
  synthetic [barcode part1]
ccaggtgcgagataac

SEQ ID NO: 35518 - DNA, 16 bp, Artificial Sequence
  synthetic [barcode part1]
gattcactctgtcgcg

SEQ ID NO: 35519 - DNA, 16 bp, Artificial Sequence
  synthetic [barcode part1]
gcgttcgtattattcg

SEQ ID NO: 35520 - DNA, 16 bp, Artificial Sequence
  synthetic [barcode part1]
tgaaggaacgccggtt

SEQ ID NO: 35521 - DNA, 16 bp, Artificial Sequence
  synthetic [barcode part1]
tctattaggaggccgt

SEQ ID NO: 35522 - DNA, 16 bp, Artificial Sequence
  synthetic [barcode part1]
tgactctcgaccgtgt

SEQ ID NO: 35523 - DNA, 16 bp, Artificial Sequence
  synthetic [barcode part1]
gtgcgaatccggtaag

SEQ ID NO: 35524 - DNA, 16 bp, Artificial Sequence
  synthetic [barcode part1]
tggtcctgagattgac

SEQ ID NO: 35525 - DNA, 16 bp, Artificial Sequence
  synthetic [barcode part1]
caatcacttatcgtcg

SEQ ID NO: 35526 - DNA, 16 bp, Artificial Sequence
  synthetic [barcode part1]
ttaccgtcctggacgt

SEQ ID NO: 35527 - DNA, 16 bp, Artificial Sequence
  synthetic [barcode part1]
tcgacttgtgactact

SEQ ID NO: 35528 - DNA, 16 bp, Artificial Sequence
  synthetic [barcode part1]
gccaagttgaaccgtt

SEQ ID NO: 35529 - DNA, 16 bp, Artificial Sequence
  synthetic [barcode part1]
atacgcgtgactggtt

SEQ ID NO: 35530 - DNA, 16 bp, Artificial Sequence
  synthetic [barcode part1]
tcgttgcgcagattcc

SEQ ID NO: 35531 - DNA, 16 bp, Artificial Sequence
  synthetic [barcode part1]
tggacgttcttactgt

SEQ ID NO: 35532 - DNA, 16 bp, Artificial Sequence
  synthetic [barcode part1]
tagaagtggactatcg

SEQ ID NO: 35533 - DNA, 16 bp, Artificial Sequence
  synthetic [barcode part1]
cgtgtcgtaactgtag

SEQ ID NO: 35534 - DNA, 16 bp, Artificial Sequence
  synthetic [barcode part1]
cgtgtaagtctcttac

SEQ ID NO: 35535 - DNA, 16 bp, Artificial Sequence
  synthetic [barcode part1]
cgcgtccagactattc

SEQ ID NO: 35536 - DNA, 16 bp, Artificial Sequence
  synthetic [barcode part1]
ccttgacgactatatc

SEQ ID NO: 35537 - DNA, 16 bp, Artificial Sequence
  synthetic [barcode part1]
gcaggtcaaggactac

SEQ ID NO: 35538 - DNA, 16 bp, Artificial Sequence
  synthetic [barcode part1]
tcttgtagtgcgagac

SEQ ID NO: 35539 - DNA, 16 bp, Artificial Sequence
  synthetic [barcode part1]
tggtgactcaggttgt

SEQ ID NO: 35540 - DNA, 16 bp, Artificial Sequence
  synthetic [barcode part1]
tgtacagattcctcac

SEQ ID NO: 35541 - DNA, 16 bp, Artificial Sequence
  synthetic [barcode part1]
aggagacgagttagac

SEQ ID NO: 35542 - DNA, 16 bp, Artificial Sequence
  synthetic [barcode part1]
gcaactactctaactc

SEQ ID NO: 35543 - DNA, 16 bp, Artificial Sequence
  synthetic [barcode part1]
attcctggacaactct

SEQ ID NO: 35544 - DNA, 16 bp, Artificial Sequence
  synthetic [barcode part1]
tgttcactctgaggtt

SEQ ID NO: 35545 - DNA, 16 bp, Artificial Sequence
  synthetic [barcode part1]
aaggtcgatacagttg

SEQ ID NO: 35546 - DNA, 16 bp, Artificial Sequence
  synthetic [barcode part1]
aactcacacggtggag

SEQ ID NO: 35547 - DNA, 16 bp, Artificial Sequence
  synthetic [barcode part1]
acacctaaccttactg

SEQ ID NO: 35548 - DNA, 16 bp, Artificial Sequence
  synthetic [barcode part1]
gtgtacaacgcgtatc

SEQ ID NO: 35549 - DNA, 16 bp, Artificial Sequence
  synthetic [barcode part1]
atcgtccttacaagtc

SEQ ID NO: 35550 - DNA, 16 bp, Artificial Sequence
  synthetic [barcode part1]
atctgccgaactctgc

SEQ ID NO: 35551 - DNA, 16 bp, Artificial Sequence
  synthetic [barcode part1]
aactcttaccagaggc

SEQ ID NO: 35552 - DNA, 16 bp, Artificial Sequence
  synthetic [barcode part1]
accgttctaagtatcc

SEQ ID NO: 35553 - DNA, 16 bp, Artificial Sequence
  synthetic [barcode part1]
actggcgataaggcac

SEQ ID NO: 35554 - DNA, 16 bp, Artificial Sequence
  synthetic [barcode part1]
acgcagtaagaggcct

SEQ ID NO: 35555 - DNA, 16 bp, Artificial Sequence
  synthetic [barcode part1]
aaggacgacctaatac

SEQ ID NO: 35556 - DNA, 16 bp, Artificial Sequence
  synthetic [barcode part1]
aacggttgaggcacac

SEQ ID NO: 35557 - DNA, 16 bp, Artificial Sequence
  synthetic [barcode part1]
gtaactgttggcctcc

SEQ ID NO: 35558 - DNA, 16 bp, Artificial Sequence
  synthetic [barcode part1]
cacgagtagacctact

SEQ ID NO: 35559 - DNA, 16 bp, Artificial Sequence
  synthetic [barcode part1]
tacttggtgacaagag

SEQ ID NO: 35560 - DNA, 16 bp, Artificial Sequence
  synthetic [barcode part1]
tagaccagtcaagtcc

SEQ ID NO: 35561 - DNA, 16 bp, Artificial Sequence
  synthetic [barcode part1]
gcctatatcagacacg

SEQ ID NO: 35562 - DNA, 16 bp, Artificial Sequence
  synthetic [barcode part1]
acagtatcgtgcacgt

SEQ ID NO: 35563 - DNA, 16 bp, Artificial Sequence
  synthetic [barcode part1]
atcgtccagtgtctgc

SEQ ID NO: 35564 - DNA, 16 bp, Artificial Sequence
  synthetic [barcode part1]
gtctccacggattgtc

SEQ ID NO: 35565 - DNA, 16 bp, Artificial Sequence
  synthetic [barcode part1]
tcgtattgacgatctc

SEQ ID NO: 35566 - DNA, 16 bp, Artificial Sequence
  synthetic [barcode part1]
caatcttcgtaatcgc

SEQ ID NO: 35567 - DNA, 16 bp, Artificial Sequence
  synthetic [barcode part1]
cagtggatactacctg

SEQ ID NO: 35568 - DNA, 16 bp, Artificial Sequence
  synthetic [barcode part1]
cctaactgtatcgact

SEQ ID NO: 35569 - DNA, 16 bp, Artificial Sequence
  synthetic [barcode part1]
cctgaccggaattagt

SEQ ID NO: 35570 - DNA, 16 bp, Artificial Sequence
  synthetic [barcode part1]
gccggataggttattc

SEQ ID NO: 35571 - DNA, 16 bp, Artificial Sequence
  synthetic [barcode part1]
gtcgccttgcctaagt

SEQ ID NO: 35572 - DNA, 16 bp, Artificial Sequence
  synthetic [barcode part1]
cgtgcaactgccactt

SEQ ID NO: 35573 - DNA, 16 bp, Artificial Sequence
  synthetic [barcode part1]
tgaagtcactgactgc

SEQ ID NO: 35574 - DNA, 16 bp, Artificial Sequence
  synthetic [barcode part1]
taggaccgaagttcct

SEQ ID NO: 35575 - DNA, 16 bp, Artificial Sequence
  synthetic [barcode part1]
tcttacaccgaattgc

SEQ ID NO: 35576 - DNA, 16 bp, Artificial Sequence
  synthetic [barcode part1]
attcctaggtgcagac

SEQ ID NO: 35577 - DNA, 16 bp, Artificial Sequence
  synthetic [barcode part1]
aagtaccggacaacgc

SEQ ID NO: 35578 - DNA, 16 bp, Artificial Sequence
  synthetic [barcode part1]
cgtcggaacaagaacc

SEQ ID NO: 35579 - DNA, 16 bp, Artificial Sequence
  synthetic [barcode part1]
ttgcggacaggagact

SEQ ID NO: 35580 - DNA, 16 bp, Artificial Sequence
  synthetic [barcode part1]
tatatccggacgtgac

SEQ ID NO: 35581 - DNA, 16 bp, Artificial Sequence
  synthetic [barcode part1]
aggacacaacctgacg

SEQ ID NO: 35582 - DNA, 16 bp, Artificial Sequence
  synthetic [barcode part1]
agactcagaattggac

SEQ ID NO: 35583 - DNA, 16 bp, Artificial Sequence
  synthetic [barcode part1]
tccgattcgaccacgt

SEQ ID NO: 35584 - DNA, 16 bp, Artificial Sequence
  synthetic [barcode part1]
gaactgtctgttggac

SEQ ID NO: 35585 - DNA, 16 bp, Artificial Sequence
  synthetic [barcode part1]
gagtgacagtcgtgtg

SEQ ID NO: 35586 - DNA, 16 bp, Artificial Sequence
  synthetic [barcode part1]
gttgagtgtgacctac

SEQ ID NO: 35587 - DNA, 16 bp, Artificial Sequence
  synthetic [barcode part1]
ccgttctcgtaggttg

SEQ ID NO: 35588 - DNA, 16 bp, Artificial Sequence
  synthetic [barcode part1]
cgaatacttccaccgc

SEQ ID NO: 35589 - DNA, 16 bp, Artificial Sequence
  synthetic [barcode part1]
tacaagtctgtcctgt

SEQ ID NO: 35590 - DNA, 16 bp, Artificial Sequence
  synthetic [barcode part1]
tctaggattcctcctc

SEQ ID NO: 35591 - DNA, 16 bp, Artificial Sequence
  synthetic [barcode part1]
acggtccttgttagag

SEQ ID NO: 35592 - DNA, 16 bp, Artificial Sequence
  synthetic [barcode part1]
aaggttctagataggc

SEQ ID NO: 35593 - DNA, 16 bp, Artificial Sequence
  synthetic [barcode part1]
ttagtagtccggtggt

SEQ ID NO: 35594 - DNA, 16 bp, Artificial Sequence
  synthetic [barcode part1]
aggtcagactggtacg

SEQ ID NO: 35595 - DNA, 16 bp, Artificial Sequence
  synthetic [barcode part1]
tccttagacgccggtt

SEQ ID NO: 35596 - DNA, 16 bp, Artificial Sequence
  synthetic [barcode part1]
gtgaccaagtcggagt

SEQ ID NO: 35597 - DNA, 16 bp, Artificial Sequence
  synthetic [barcode part1]
aattctccggtaaggc

SEQ ID NO: 35598 - DNA, 16 bp, Artificial Sequence
  synthetic [barcode part1]
tctacttctcgcctag

SEQ ID NO: 35599 - DNA, 16 bp, Artificial Sequence
  synthetic [barcode part1]
cacaccttcgttggac

SEQ ID NO: 35600 - DNA, 16 bp, Artificial Sequence
  synthetic [barcode part1]
tgaggtggttcgaacg

SEQ ID NO: 35601 - DNA, 16 bp, Artificial Sequence
  synthetic [barcode part1]
aggcaactaatcctcg

SEQ ID NO: 35602 - DNA, 16 bp, Artificial Sequence
  synthetic [barcode part1]
agaatagaagtctgcc

SEQ ID NO: 35603 - DNA, 16 bp, Artificial Sequence
  synthetic [barcode part1]
aaggcactcaatagtg

SEQ ID NO: 35604 - DNA, 16 bp, Artificial Sequence
  synthetic [barcode part1]
ttcctgccgaatcacg

SEQ ID NO: 35605 - DNA, 16 bp, Artificial Sequence
  synthetic [barcode part1]
tgaaccttccagacag

SEQ ID NO: 35606 - DNA, 16 bp, Artificial Sequence
  synthetic [barcode part1]
gcgattacacagttgc

SEQ ID NO: 35607 - DNA, 16 bp, Artificial Sequence
  synthetic [barcode part1]
gaaggtgatagaggtc

SEQ ID NO: 35608 - DNA, 16 bp, Artificial Sequence
  synthetic [barcode part1]
aaggtcgaacttgtag

SEQ ID NO: 35609 - DNA, 16 bp, Artificial Sequence
  synthetic [barcode part1]
gtacgtacaaccagtc

SEQ ID NO: 35610 - DNA, 16 bp, Artificial Sequence
  synthetic [barcode part1]
ccacgtcttgttaagt

SEQ ID NO: 35611 - DNA, 16 bp, Artificial Sequence
  synthetic [barcode part1]
cagaggtgaactgtcg

SEQ ID NO: 35612 - DNA, 16 bp, Artificial Sequence
  synthetic [barcode part1]
gtcgaccgttaactag

SEQ ID NO: 35613 - DNA, 16 bp, Artificial Sequence
  synthetic [barcode part1]
cagtacggatctacgt

SEQ ID NO: 35614 - DNA, 16 bp, Artificial Sequence
  synthetic [barcode part1]
atccttaatctggcac

SEQ ID NO: 35615 - DNA, 16 bp, Artificial Sequence
  synthetic [barcode part1]
tagaacagacgacgag

SEQ ID NO: 35616 - DNA, 16 bp, Artificial Sequence
  synthetic [barcode part1]
gtactaacgcactggt

SEQ ID NO: 35617 - DNA, 16 bp, Artificial Sequence
  synthetic [barcode part1]
tcgaagtacaacgtcc

SEQ ID NO: 35618 - DNA, 16 bp, Artificial Sequence
  synthetic [barcode part1]
ttcgtgtctgaactgt

SEQ ID NO: 35619 - DNA, 16 bp, Artificial Sequence
  synthetic [barcode part1]
ttaaggagattgcgtg

SEQ ID NO: 35620 - DNA, 16 bp, Artificial Sequence
  synthetic [barcode part1]
ataggccgtacaacct

SEQ ID NO: 35621 - DNA, 16 bp, Artificial Sequence
  synthetic [barcode part1]
aattggaccacgcgag

SEQ ID NO: 35622 - DNA, 16 bp, Artificial Sequence
  synthetic [barcode part1]
tagtgaaggtgaggtg

SEQ ID NO: 35623 - DNA, 16 bp, Artificial Sequence
  synthetic [barcode part1]
ttagttctgaacctgc

SEQ ID NO: 35624 - DNA, 16 bp, Artificial Sequence
  synthetic [barcode part1]
actctcagttcaacgt

SEQ ID NO: 35625 - DNA, 16 bp, Artificial Sequence
  synthetic [barcode part1]
ttacttcttgaacgcg

SEQ ID NO: 35626 - DNA, 16 bp, Artificial Sequence
  synthetic [barcode part1]
gcgaatctagttcctt

SEQ ID NO: 35627 - DNA, 16 bp, Artificial Sequence
  synthetic [barcode part1]
agaatccaacaggcgc

SEQ ID NO: 35628 - DNA, 16 bp, Artificial Sequence
  synthetic [barcode part1]
tggtgaccagtctagt

SEQ ID NO: 35629 - DNA, 16 bp, Artificial Sequence
  synthetic [barcode part1]
tctgagaatacgcacc

SEQ ID NO: 35630 - DNA, 16 bp, Artificial Sequence
  synthetic [barcode part1]
gcctaatctccacacg

SEQ ID NO: 35631 - DNA, 16 bp, Artificial Sequence
  synthetic [barcode part1]
tgacctccaactgcac

SEQ ID NO: 35632 - DNA, 16 bp, Artificial Sequence
  synthetic [barcode part1]
tagttcggacgattcg

SEQ ID NO: 35633 - DNA, 16 bp, Artificial Sequence
  synthetic [barcode part1]
gccgtagagtggatac

SEQ ID NO: 35634 - DNA, 16 bp, Artificial Sequence
  synthetic [barcode part1]
tatctggcggtcttcg

SEQ ID NO: 35635 - DNA, 16 bp, Artificial Sequence
  synthetic [barcode part1]
gtggtgttcgagatct

SEQ ID NO: 35636 - DNA, 16 bp, Artificial Sequence
  synthetic [barcode part1]
cacaatcgagacggtg

SEQ ID NO: 35637 - DNA, 16 bp, Artificial Sequence
  synthetic [barcode part1]
gcgagtcgtcaagaac

SEQ ID NO: 35638 - DNA, 16 bp, Artificial Sequence
  synthetic [barcode part1]
atcggattggagatac

SEQ ID NO: 35639 - DNA, 16 bp, Artificial Sequence
  synthetic [barcode part1]
tggacttcaagacaag

SEQ ID NO: 35640 - DNA, 16 bp, Artificial Sequence
  synthetic [barcode part1]
tcttctcgtcgtagtc

SEQ ID NO: 35641 - DNA, 16 bp, Artificial Sequence
  synthetic [barcode part1]
gaatactctcgtcact

SEQ ID NO: 35642 - DNA, 16 bp, Artificial Sequence
  synthetic [barcode part1]
aggcagacttagaatc

SEQ ID NO: 35643 - DNA, 16 bp, Artificial Sequence
  synthetic [barcode part1]
tctaatcaccggcacc

SEQ ID NO: 35644 - DNA, 16 bp, Artificial Sequence
  synthetic [barcode part1]
cactcgttattgcggc

SEQ ID NO: 35645 - DNA, 16 bp, Artificial Sequence
  synthetic [barcode part1]
cgagacttcagttggt

SEQ ID NO: 35646 - DNA, 16 bp, Artificial Sequence
  synthetic [barcode part1]
atattccggtcactac

SEQ ID NO: 35647 - DNA, 16 bp, Artificial Sequence
  synthetic [barcode part1]
aacttaacgatccggc

SEQ ID NO: 35648 - DNA, 16 bp, Artificial Sequence
  synthetic [barcode part1]
cgccacaagtcttaag

SEQ ID NO: 35649 - DNA, 16 bp, Artificial Sequence
  synthetic [barcode part1]
aatagacggtatcgtg

SEQ ID NO: 35650 - DNA, 16 bp, Artificial Sequence
  synthetic [barcode part1]
gccttggtcgattaag

SEQ ID NO: 35651 - DNA, 16 bp, Artificial Sequence
  synthetic [barcode part1]
ttgtggacgtctcacc

SEQ ID NO: 35652 - DNA, 16 bp, Artificial Sequence
  synthetic [barcode part1]
taagtgaccacaacag

SEQ ID NO: 35653 - DNA, 16 bp, Artificial Sequence
  synthetic [barcode part1]
gcctctgttgccaagt

SEQ ID NO: 35654 - DNA, 16 bp, Artificial Sequence
  synthetic [barcode part1]
cagactactctcacgc

SEQ ID NO: 35655 - DNA, 16 bp, Artificial Sequence
  synthetic [barcode part1]
aacacgccgacgtatt

SEQ ID NO: 35656 - DNA, 16 bp, Artificial Sequence
  synthetic [barcode part1]
ttgcctactgtggcgt

SEQ ID NO: 35657 - DNA, 16 bp, Artificial Sequence
  synthetic [barcode part1]
acagtggacaaggtag

SEQ ID NO: 35658 - DNA, 16 bp, Artificial Sequence
  synthetic [barcode part1]
cgcacctagatcacct

SEQ ID NO: 35659 - DNA, 16 bp, Artificial Sequence
  synthetic [barcode part1]
gacagttcgactcaac

SEQ ID NO: 35660 - DNA, 16 bp, Artificial Sequence
  synthetic [barcode part1]
ttcagtggacaatccg

SEQ ID NO: 35661 - DNA, 16 bp, Artificial Sequence
  synthetic [barcode part1]
attgtcgccagtaacg

SEQ ID NO: 35662 - DNA, 16 bp, Artificial Sequence
  synthetic [barcode part1]
tctccttccagaactc

SEQ ID NO: 35663 - DNA, 16 bp, Artificial Sequence
  synthetic [barcode part1]
tcagtgttgtgcagtg

SEQ ID NO: 35664 - DNA, 16 bp, Artificial Sequence
  synthetic [barcode part1]
tattccgattccgcct

SEQ ID NO: 35665 - DNA, 16 bp, Artificial Sequence
  synthetic [barcode part1]
ataatcgtcgagaggt

SEQ ID NO: 35666 - DNA, 16 bp, Artificial Sequence
  synthetic [barcode part1]
tcggttccgttaacgc

SEQ ID NO: 35667 - DNA, 16 bp, Artificial Sequence
  synthetic [barcode part1]
gaatattggcagaacc

SEQ ID NO: 35668 - DNA, 16 bp, Artificial Sequence
  synthetic [barcode part1]
cggtgatctctgcact

SEQ ID NO: 35669 - DNA, 16 bp, Artificial Sequence
  synthetic [barcode part1]
caagacgagtagtgag

SEQ ID NO: 35670 - DNA, 16 bp, Artificial Sequence
  synthetic [barcode part1]
cctgagagattctggt

SEQ ID NO: 35671 - DNA, 16 bp, Artificial Sequence
  synthetic [barcode part1]
gagtaggtatccgttc

SEQ ID NO: 35672 - DNA, 16 bp, Artificial Sequence
  synthetic [barcode part1]
aatccttgtattcggc

SEQ ID NO: 35673 - DNA, 16 bp, Artificial Sequence
  synthetic [barcode part1]
attcgtggcgttcaag

SEQ ID NO: 35674 - DNA, 16 bp, Artificial Sequence
  synthetic [barcode part1]
ccggtaattgccaagt

SEQ ID NO: 35675 - DNA, 16 bp, Artificial Sequence
  synthetic [barcode part1]
aagactagagacggtg

SEQ ID NO: 35676 - DNA, 16 bp, Artificial Sequence
  synthetic [barcode part1]
ttcttggcgtagttgt

SEQ ID NO: 35677 - DNA, 16 bp, Artificial Sequence
  synthetic [barcode part1]
gacttgtcaccgtctg

SEQ ID NO: 35678 - DNA, 16 bp, Artificial Sequence
  synthetic [barcode part1]
gtaacaagacggtgag

SEQ ID NO: 35679 - DNA, 16 bp, Artificial Sequence
  synthetic [barcode part1]
aaccttccgcagacct

SEQ ID NO: 35680 - DNA, 16 bp, Artificial Sequence
  synthetic [barcode part1]
agtcgattcagtcgac

SEQ ID NO: 35681 - DNA, 16 bp, Artificial Sequence
  synthetic [barcode part1]
gcgattattggaagac

SEQ ID NO: 35682 - DNA, 16 bp, Artificial Sequence
  synthetic [barcode part1]
caggaaggtattaacc

SEQ ID NO: 35683 - DNA, 16 bp, Artificial Sequence
  synthetic [barcode part1]
aggcgagacctcaagt

SEQ ID NO: 35684 - DNA, 16 bp, Artificial Sequence
  synthetic [barcode part1]
gcaaggtgtgaactcg

SEQ ID NO: 35685 - DNA, 16 bp, Artificial Sequence
  synthetic [barcode part1]
gttagacgccttcgtc

SEQ ID NO: 35686 - DNA, 16 bp, Artificial Sequence
  synthetic [barcode part1]
acctctacctggcagt

SEQ ID NO: 35687 - DNA, 16 bp, Artificial Sequence
  synthetic [barcode part1]
aagtagaggaccttac

SEQ ID NO: 35688 - DNA, 16 bp, Artificial Sequence
  synthetic [barcode part1]
tgaacaagacgtcgcg

SEQ ID NO: 35689 - DNA, 16 bp, Artificial Sequence
  synthetic [barcode part1]
ttcaatccggtacgcc

SEQ ID NO: 35690 - DNA, 16 bp, Artificial Sequence
  synthetic [barcode part1]
caggagagtcgatacc

SEQ ID NO: 35691 - DNA, 16 bp, Artificial Sequence
  synthetic [barcode part1]
ccagtctgtaaggtac

SEQ ID NO: 35692 - DNA, 16 bp, Artificial Sequence
  synthetic [barcode part1]
ccgatccgatatatct

SEQ ID NO: 35693 - DNA, 16 bp, Artificial Sequence
  synthetic [barcode part1]
cctactgtcgagtacc

SEQ ID NO: 35694 - DNA, 16 bp, Artificial Sequence
  synthetic [barcode part1]
agactgtctcacgtcc

SEQ ID NO: 35695 - DNA, 16 bp, Artificial Sequence
  synthetic [barcode part1]
gcagagtaacgcctag

SEQ ID NO: 35696 - DNA, 16 bp, Artificial Sequence
  synthetic [barcode part1]
tgttcgaagtcacacg

SEQ ID NO: 35697 - DNA, 16 bp, Artificial Sequence
  synthetic [barcode part1]
gtagtcacctcgatcc

SEQ ID NO: 35698 - DNA, 16 bp, Artificial Sequence
  synthetic [barcode part1]
tgcctaaccttactag

SEQ ID NO: 35699 - DNA, 16 bp, Artificial Sequence
  synthetic [barcode part1]
actcgaaggatctgtc

SEQ ID NO: 35700 - DNA, 16 bp, Artificial Sequence
  synthetic [barcode part1]
ttcgattgtgcactac

SEQ ID NO: 35701 - DNA, 16 bp, Artificial Sequence
  synthetic [barcode part1]
atcggatccgtactcc

SEQ ID NO: 35702 - DNA, 16 bp, Artificial Sequence
  synthetic [barcode part1]
ccgtatcgcctaacac

SEQ ID NO: 35703 - DNA, 16 bp, Artificial Sequence
  synthetic [barcode part1]
agtctagtcagatcgc

SEQ ID NO: 35704 - DNA, 16 bp, Artificial Sequence
  synthetic [barcode part1]
tcaagtggtgagtctc

SEQ ID NO: 35705 - DNA, 16 bp, Artificial Sequence
  synthetic [barcode part1]
gtacttcgattaccgt

SEQ ID NO: 35706 - DNA, 16 bp, Artificial Sequence
  synthetic [barcode part1]
aggccaagttgtatag

SEQ ID NO: 35707 - DNA, 16 bp, Artificial Sequence
  synthetic [barcode part1]
ttataagttgccgtcc

SEQ ID NO: 35708 - DNA, 16 bp, Artificial Sequence
  synthetic [barcode part1]
ttgcagaccgttgtcc

SEQ ID NO: 35709 - DNA, 16 bp, Artificial Sequence
  synthetic [barcode part1]
acttggttgactcgag

SEQ ID NO: 35710 - DNA, 16 bp, Artificial Sequence
  synthetic [barcode part1]
aagtacagtcgccgag

SEQ ID NO: 35711 - DNA, 16 bp, Artificial Sequence
  synthetic [barcode part1]
gccttcgactcaacgt

SEQ ID NO: 35712 - DNA, 16 bp, Artificial Sequence
  synthetic [barcode part1]
tatccgttatcgtggt

SEQ ID NO: 35713 - DNA, 16 bp, Artificial Sequence
  synthetic [barcode part1]
gaacggactcagaacc

SEQ ID NO: 35714 - DNA, 16 bp, Artificial Sequence
  synthetic [barcode part1]
gagtaagtaccgtagt

SEQ ID NO: 35715 - DNA, 16 bp, Artificial Sequence
  synthetic [barcode part1]
cgtactctattgagtc

SEQ ID NO: 35716 - DNA, 16 bp, Artificial Sequence
  synthetic [barcode part1]
ttagttcactcgagtc

SEQ ID NO: 35717 - DNA, 16 bp, Artificial Sequence
  synthetic [barcode part1]
tagagaatcaggaggc

SEQ ID NO: 35718 - DNA, 16 bp, Artificial Sequence
  synthetic [barcode part1]
cctaccgcgtgaatct

SEQ ID NO: 35719 - DNA, 16 bp, Artificial Sequence
  synthetic [barcode part1]
cggagaagatcttctc

SEQ ID NO: 35720 - DNA, 16 bp, Artificial Sequence
  synthetic [barcode part1]
tgacctcgtgtaccac

SEQ ID NO: 35721 - DNA, 16 bp, Artificial Sequence
  synthetic [barcode part1]
tacaggccgaggtagt

SEQ ID NO: 35722 - DNA, 16 bp, Artificial Sequence
  synthetic [barcode part1]
caccacttaaggaacc

SEQ ID NO: 35723 - DNA, 16 bp, Artificial Sequence
  synthetic [barcode part1]
agacctagtctggatc

SEQ ID NO: 35724 - DNA, 16 bp, Artificial Sequence
  synthetic [barcode part1]
gaggtgtcagtagtcg

SEQ ID NO: 35725 - DNA, 16 bp, Artificial Sequence
  synthetic [barcode part1]
gacttcaacaggtaag

SEQ ID NO: 35726 - DNA, 16 bp, Artificial Sequence
  synthetic [barcode part1]
tcagacactataggcc

SEQ ID NO: 35727 - DNA, 16 bp, Artificial Sequence
  synthetic [barcode part1]
atcggagtgtgtgacg

SEQ ID NO: 35728 - DNA, 16 bp, Artificial Sequence
  synthetic [barcode part1]
cgtctactcgtgacac

SEQ ID NO: 35729 - DNA, 16 bp, Artificial Sequence
  synthetic [barcode part1]
attcgactgtaccttg

SEQ ID NO: 35730 - DNA, 16 bp, Artificial Sequence
  synthetic [barcode part1]
cgaaggtgcaatccag

SEQ ID NO: 35731 - DNA, 16 bp, Artificial Sequence
  synthetic [barcode part1]
cgtagtgacgaacggt

SEQ ID NO: 35732 - DNA, 16 bp, Artificial Sequence
  synthetic [barcode part1]
cggcaacttcttacgc

SEQ ID NO: 35733 - DNA, 16 bp, Artificial Sequence
  synthetic [barcode part1]
cgtgtccggtataagt

SEQ ID NO: 35734 - DNA, 16 bp, Artificial Sequence
  synthetic [barcode part1]
gtgtaattggtcgcgt

SEQ ID NO: 35735 - DNA, 16 bp, Artificial Sequence
  synthetic [barcode part1]
attgtccgagtgacgt

SEQ ID NO: 35736 - DNA, 16 bp, Artificial Sequence
  synthetic [barcode part1]
gaagtatctggtagtg

SEQ ID NO: 35737 - DNA, 16 bp, Artificial Sequence
  synthetic [barcode part1]
tcaagaccgtctattc

SEQ ID NO: 35738 - DNA, 16 bp, Artificial Sequence
  synthetic [barcode part1]
gacgtgaagtggtctg

SEQ ID NO: 35739 - DNA, 16 bp, Artificial Sequence
  synthetic [barcode part1]
ccaacgaagtgactct

SEQ ID NO: 35740 - DNA, 16 bp, Artificial Sequence
  synthetic [barcode part1]
agtctgattctacgtc

SEQ ID NO: 35741 - DNA, 16 bp, Artificial Sequence
  synthetic [barcode part1]
cactaagttcggtgac

SEQ ID NO: 35742 - DNA, 16 bp, Artificial Sequence
  synthetic [barcode part1]
aattacagtgccggtc

SEQ ID NO: 35743 - DNA, 16 bp, Artificial Sequence
  synthetic [barcode part1]
tgaactgttggcaacc

SEQ ID NO: 35744 - DNA, 16 bp, Artificial Sequence
  synthetic [barcode part1]
ccgaatagtagacctc

SEQ ID NO: 35745 - DNA, 16 bp, Artificial Sequence
  synthetic [barcode part1]
ccacaccacaggaatt

SEQ ID NO: 35746 - DNA, 16 bp, Artificial Sequence
  synthetic [barcode part1]
ttcgtgacaccgttcg

SEQ ID NO: 35747 - DNA, 16 bp, Artificial Sequence
  synthetic [barcode part1]
ccgtgtgaagatcgag

SEQ ID NO: 35748 - DNA, 16 bp, Artificial Sequence
  synthetic [barcode part1]
agtaaccagtccaacc

SEQ ID NO: 35749 - DNA, 16 bp, Artificial Sequence
  synthetic [barcode part1]
gataccggagatcctt

SEQ ID NO: 35750 - DNA, 16 bp, Artificial Sequence
  synthetic [barcode part1]
aacgtaaggactgttg

SEQ ID NO: 35751 - DNA, 16 bp, Artificial Sequence
  synthetic [barcode part1]
caacctacctaacgag

SEQ ID NO: 35752 - DNA, 16 bp, Artificial Sequence
  synthetic [barcode part1]
cggcgacagttattgt

SEQ ID NO: 35753 - DNA, 16 bp, Artificial Sequence
  synthetic [barcode part1]
acacctcgacttaatc

SEQ ID NO: 35754 - DNA, 16 bp, Artificial Sequence
  synthetic [barcode part1]
gacctgaatcgaacct

SEQ ID NO: 35755 - DNA, 16 bp, Artificial Sequence
  synthetic [barcode part1]
cacagtgcctgtctgt

SEQ ID NO: 35756 - DNA, 16 bp, Artificial Sequence
  synthetic [barcode part1]
tggttcaacttctacg

SEQ ID NO: 35757 - DNA, 16 bp, Artificial Sequence
  synthetic [barcode part1]
attccgactctctctg

SEQ ID NO: 35758 - DNA, 16 bp, Artificial Sequence
  synthetic [barcode part1]
ttctcgaaccaacact

SEQ ID NO: 35759 - DNA, 16 bp, Artificial Sequence
  synthetic [barcode part1]
acttggatatccggac

SEQ ID NO: 35760 - DNA, 16 bp, Artificial Sequence
  synthetic [barcode part1]
cgagtgcaatcgtatc

SEQ ID NO: 35761 - DNA, 16 bp, Artificial Sequence
  synthetic [barcode part1]
gtcgttcagatccgtc

SEQ ID NO: 35762 - DNA, 16 bp, Artificial Sequence
  synthetic [barcode part1]
gtatcgtgtctattcg

SEQ ID NO: 35763 - DNA, 16 bp, Artificial Sequence
  synthetic [barcode part1]
tgttcacgcagtatct

SEQ ID NO: 35764 - DNA, 16 bp, Artificial Sequence
  synthetic [barcode part1]
actacacctagtgcag

SEQ ID NO: 35765 - DNA, 16 bp, Artificial Sequence
  synthetic [barcode part1]
tcttggtaaccacgtt

SEQ ID NO: 35766 - DNA, 16 bp, Artificial Sequence
  synthetic [barcode part1]
ccaccaccttagacgt

SEQ ID NO: 35767 - DNA, 16 bp, Artificial Sequence
  synthetic [barcode part1]
cgtatagtccacgaac

SEQ ID NO: 35768 - DNA, 16 bp, Artificial Sequence
  synthetic [barcode part1]
acgttgataacaggac

SEQ ID NO: 35769 - DNA, 16 bp, Artificial Sequence
  synthetic [barcode part1]
cgacctctcagttctt

SEQ ID NO: 35770 - DNA, 16 bp, Artificial Sequence
  synthetic [barcode part1]
gacgtatcttcaactc

SEQ ID NO: 35771 - DNA, 16 bp, Artificial Sequence
  synthetic [barcode part1]
attacaactgtccacc

SEQ ID NO: 35772 - DNA, 16 bp, Artificial Sequence
  synthetic [barcode part1]
gttcgagttgcagact

SEQ ID NO: 35773 - DNA, 16 bp, Artificial Sequence
  synthetic [barcode part1]
acgttctcagtgatct

SEQ ID NO: 35774 - DNA, 16 bp, Artificial Sequence
  synthetic [barcode part1]
cgtgtaatagagaacc

SEQ ID NO: 35775 - DNA, 16 bp, Artificial Sequence
  synthetic [barcode part1]
aatctaatcctcgcac

SEQ ID NO: 35776 - DNA, 16 bp, Artificial Sequence
  synthetic [barcode part1]
cgttccacgttatctc

SEQ ID NO: 35777 - DNA, 16 bp, Artificial Sequence
  synthetic [barcode part1]
agtgtaatcacgtccg

SEQ ID NO: 35778 - DNA, 16 bp, Artificial Sequence
  synthetic [barcode part1]
acgatctgccttcgtg

SEQ ID NO: 35779 - DNA, 16 bp, Artificial Sequence
  synthetic [barcode part1]
acaagaattggcgatc

SEQ ID NO: 35780 - DNA, 16 bp, Artificial Sequence
  synthetic [barcode part1]
agagtaactcaccacc

SEQ ID NO: 35781 - DNA, 16 bp, Artificial Sequence
  synthetic [barcode part1]
caaggttgccgattac

SEQ ID NO: 35782 - DNA, 16 bp, Artificial Sequence
  synthetic [barcode part1]
tatcaggcctagtgac

SEQ ID NO: 35783 - DNA, 16 bp, Artificial Sequence
  synthetic [barcode part1]
ttgttcggtaacgtct

SEQ ID NO: 35784 - DNA, 16 bp, Artificial Sequence
  synthetic [barcode part1]
ttcgcgttctctgtac

SEQ ID NO: 35785 - DNA, 16 bp, Artificial Sequence
  synthetic [barcode part1]
acgaaggaatccgacc

SEQ ID NO: 35786 - DNA, 16 bp, Artificial Sequence
  synthetic [barcode part1]
ccgttgcgatactcgt

SEQ ID NO: 35787 - DNA, 16 bp, Artificial Sequence
  synthetic [barcode part1]
tcgtgatattgcggtg

SEQ ID NO: 35788 - DNA, 16 bp, Artificial Sequence
  synthetic [barcode part1]
tcggacaacttgcagt

SEQ ID NO: 35789 - DNA, 16 bp, Artificial Sequence
  synthetic [barcode part1]
aatacgttcgaggagt

SEQ ID NO: 35790 - DNA, 16 bp, Artificial Sequence
  synthetic [barcode part1]
tacttcgacggattct

SEQ ID NO: 35791 - DNA, 16 bp, Artificial Sequence
  synthetic [barcode part1]
tgatctgtcacgcctg

SEQ ID NO: 35792 - DNA, 16 bp, Artificial Sequence
  synthetic [barcode part1]
tacctatattccaggc

SEQ ID NO: 35793 - DNA, 16 bp, Artificial Sequence
  synthetic [barcode part1]
tagttccggtctcctt

SEQ ID NO: 35794 - DNA, 16 bp, Artificial Sequence
  synthetic [barcode part1]
agtagaggcactcggt

SEQ ID NO: 35795 - DNA, 16 bp, Artificial Sequence
  synthetic [barcode part1]
tcttagtgattcgtgc

SEQ ID NO: 35796 - DNA, 16 bp, Artificial Sequence
  synthetic [barcode part1]
tcaggaggactgtgtg

SEQ ID NO: 35797 - DNA, 16 bp, Artificial Sequence
  synthetic [barcode part1]
tcggcactctcaactg

SEQ ID NO: 35798 - DNA, 16 bp, Artificial Sequence
  synthetic [barcode part1]
gcacaacttctggcct

SEQ ID NO: 35799 - DNA, 16 bp, Artificial Sequence
  synthetic [barcode part1]
gcggttgttggagaac

SEQ ID NO: 35800 - DNA, 16 bp, Artificial Sequence
  synthetic [barcode part1]
gtagtgtggttctgac

SEQ ID NO: 35801 - DNA, 16 bp, Artificial Sequence
  synthetic [barcode part1]
aatcaaccgcgtgtgt

SEQ ID NO: 35802 - DNA, 16 bp, Artificial Sequence
  synthetic [barcode part1]
cgtgtggaagtacttc

SEQ ID NO: 35803 - DNA, 16 bp, Artificial Sequence
  synthetic [barcode part1]
ttcaccaggccgtact

SEQ ID NO: 35804 - DNA, 16 bp, Artificial Sequence
  synthetic [barcode part1]
aattgttctcgcactg

SEQ ID NO: 35805 - DNA, 16 bp, Artificial Sequence
  synthetic [barcode part1]
tagacaaggcagacag

SEQ ID NO: 35806 - DNA, 16 bp, Artificial Sequence
  synthetic [barcode part1]
agaagttctggtctcg

SEQ ID NO: 35807 - DNA, 16 bp, Artificial Sequence
  synthetic [barcode part1]
ttcgttgcacaggcct

SEQ ID NO: 35808 - DNA, 16 bp, Artificial Sequence
  synthetic [barcode part1]
aaccgttctgtgcctg

SEQ ID NO: 35809 - DNA, 16 bp, Artificial Sequence
  synthetic [barcode part1]
gtccttatccggcagt

SEQ ID NO: 35810 - DNA, 16 bp, Artificial Sequence
  synthetic [barcode part1]
gataacaccgcaggtg

SEQ ID NO: 35811 - DNA, 16 bp, Artificial Sequence
  synthetic [barcode part1]
cgactagacgttacgt

SEQ ID NO: 35812 - DNA, 16 bp, Artificial Sequence
  synthetic [barcode part1]
caggattagttccgac

SEQ ID NO: 35813 - DNA, 16 bp, Artificial Sequence
  synthetic [barcode part1]
agtcacacctcaattc

SEQ ID NO: 35814 - DNA, 16 bp, Artificial Sequence
  synthetic [barcode part1]
tagacaaggacttcag

SEQ ID NO: 35815 - DNA, 16 bp, Artificial Sequence
  synthetic [barcode part1]
gcagtatccttccttc

SEQ ID NO: 35816 - DNA, 16 bp, Artificial Sequence
  synthetic [barcode part1]
cagacgtgaggtgact

SEQ ID NO: 35817 - DNA, 16 bp, Artificial Sequence
  synthetic [barcode part1]
gtcctgcggatatcct

SEQ ID NO: 35818 - DNA, 16 bp, Artificial Sequence
  synthetic [barcode part1]
gttgcctgtagactcc

SEQ ID NO: 35819 - DNA, 16 bp, Artificial Sequence
  synthetic [barcode part1]
gcgatagatccgagtg

SEQ ID NO: 35820 - DNA, 16 bp, Artificial Sequence
  synthetic [barcode part1]
gacaactaggacgtgc

SEQ ID NO: 35821 - DNA, 16 bp, Artificial Sequence
  synthetic [barcode part1]
aaggttctccagaacc

SEQ ID NO: 35822 - DNA, 16 bp, Artificial Sequence
  synthetic [barcode part1]
tctaacgtgagttgcg

SEQ ID NO: 35823 - DNA, 16 bp, Artificial Sequence
  synthetic [barcode part1]
gcagagagttagattc

SEQ ID NO: 35824 - DNA, 16 bp, Artificial Sequence
  synthetic [barcode part1]
gtcctatccgttgtct

SEQ ID NO: 35825 - DNA, 16 bp, Artificial Sequence
  synthetic [barcode part1]
gaacggatcacttgtc

SEQ ID NO: 35826 - DNA, 16 bp, Artificial Sequence
  synthetic [barcode part1]
tacacgtacacacacg

SEQ ID NO: 35827 - DNA, 16 bp, Artificial Sequence
  synthetic [barcode part1]
tcgaaggcacgttgag

SEQ ID NO: 35828 - DNA, 16 bp, Artificial Sequence
  synthetic [barcode part1]
tactggagagttgtcc

SEQ ID NO: 35829 - DNA, 16 bp, Artificial Sequence
  synthetic [barcode part1]
gagtcgtgttcagtgt

SEQ ID NO: 35830 - DNA, 16 bp, Artificial Sequence
  synthetic [barcode part1]
ttggtacactgcacag

SEQ ID NO: 35831 - DNA, 16 bp, Artificial Sequence
  synthetic [barcode part1]
agatcctgcgttacag

SEQ ID NO: 35832 - DNA, 16 bp, Artificial Sequence
  synthetic [barcode part1]
cacagtgtgaggtctt

SEQ ID NO: 35833 - DNA, 16 bp, Artificial Sequence
  synthetic [barcode part1]
tgatataggcctgcac

SEQ ID NO: 35834 - DNA, 16 bp, Artificial Sequence
  synthetic [barcode part1]
gtctctgtaagttacc

SEQ ID NO: 35835 - DNA, 16 bp, Artificial Sequence
  synthetic [barcode part1]
tacggcctatatcgag

SEQ ID NO: 35836 - DNA, 16 bp, Artificial Sequence
  synthetic [barcode part1]
tattacacgactggcg

SEQ ID NO: 35837 - DNA, 16 bp, Artificial Sequence
  synthetic [barcode part1]
caggaaccgaatcacg

SEQ ID NO: 35838 - DNA, 16 bp, Artificial Sequence
  synthetic [barcode part1]
atcaacgcaccgatac

SEQ ID NO: 35839 - DNA, 16 bp, Artificial Sequence
  synthetic [barcode part1]
tgtgatacactgcggt

SEQ ID NO: 35840 - DNA, 16 bp, Artificial Sequence
  synthetic [barcode part1]
tcctgcaggttatcgc

SEQ ID NO: 35841 - DNA, 16 bp, Artificial Sequence
  synthetic [barcode part1]
gtcgtcctacttaagt

SEQ ID NO: 35842 - DNA, 16 bp, Artificial Sequence
  synthetic [barcode part1]
gcgttattccaaggtg

SEQ ID NO: 35843 - DNA, 16 bp, Artificial Sequence
  synthetic [barcode part1]
cactaactcaaccttg

SEQ ID NO: 35844 - DNA, 16 bp, Artificial Sequence
  synthetic [barcode part1]
gcaccgtaacggatag

SEQ ID NO: 35845 - DNA, 16 bp, Artificial Sequence
  synthetic [barcode part1]
tccgtcgtgcgaactt

SEQ ID NO: 35846 - DNA, 16 bp, Artificial Sequence
  synthetic [barcode part1]
tactgtcactctccgt

SEQ ID NO: 35847 - DNA, 16 bp, Artificial Sequence
  synthetic [barcode part1]
tcgcgactgattagtg

SEQ ID NO: 35848 - DNA, 16 bp, Artificial Sequence
  synthetic [barcode part1]
tagaccagactgtcac

SEQ ID NO: 35849 - DNA, 16 bp, Artificial Sequence
  synthetic [barcode part1]
tatagaggcacgagag

SEQ ID NO: 35850 - DNA, 16 bp, Artificial Sequence
  synthetic [barcode part1]
gtgtcggttagtacac

SEQ ID NO: 35851 - DNA, 16 bp, Artificial Sequence
  synthetic [barcode part1]
attcagacgtcactct

SEQ ID NO: 35852 - DNA, 16 bp, Artificial Sequence
  synthetic [barcode part1]
ccaggtggaataatac

SEQ ID NO: 35853 - DNA, 16 bp, Artificial Sequence
  synthetic [barcode part1]
tgtaagattggtggtg

SEQ ID NO: 35854 - DNA, 16 bp, Artificial Sequence
  synthetic [barcode part1]
caagatcaaccggttc

SEQ ID NO: 35855 - DNA, 16 bp, Artificial Sequence
  synthetic [barcode part1]
tccaattcgtagtcac

SEQ ID NO: 35856 - DNA, 16 bp, Artificial Sequence
  synthetic [barcode part1]
accggtacacctcgtt

SEQ ID NO: 35857 - DNA, 16 bp, Artificial Sequence
  synthetic [barcode part1]
tgagatacacttcgcg

SEQ ID NO: 35858 - DNA, 16 bp, Artificial Sequence
  synthetic [barcode part1]
ttctgccaggtctacg

SEQ ID NO: 35859 - DNA, 16 bp, Artificial Sequence
  synthetic [barcode part1]
gcgtacaaggagaagt

SEQ ID NO: 35860 - DNA, 16 bp, Artificial Sequence
  synthetic [barcode part1]
gttccgtgaacactcc

SEQ ID NO: 35861 - DNA, 16 bp, Artificial Sequence
  synthetic [barcode part1]
gattgcgttagaaggt

SEQ ID NO: 35862 - DNA, 16 bp, Artificial Sequence
  synthetic [barcode part1]
tcgacggtattggatc

SEQ ID NO: 35863 - DNA, 16 bp, Artificial Sequence
  synthetic [barcode part1]
agaggtggatacagac

SEQ ID NO: 35864 - DNA, 16 bp, Artificial Sequence
  synthetic [barcode part1]
tctcaatcgactcctc

SEQ ID NO: 35865 - DNA, 16 bp, Artificial Sequence
  synthetic [barcode part1]
atcttggttggccaag

SEQ ID NO: 35866 - DNA, 16 bp, Artificial Sequence
  synthetic [barcode part1]
accttgtgaacacctt

SEQ ID NO: 35867 - DNA, 16 bp, Artificial Sequence
  synthetic [barcode part1]
attcaccggattctgt

SEQ ID NO: 35868 - DNA, 16 bp, Artificial Sequence
  synthetic [barcode part1]
gagagtacgttaggtt

SEQ ID NO: 35869 - DNA, 16 bp, Artificial Sequence
  synthetic [barcode part1]
acaggacactcgtgag

SEQ ID NO: 35870 - DNA, 16 bp, Artificial Sequence
  synthetic [barcode part1]
accactagaagtacag

SEQ ID NO: 35871 - DNA, 16 bp, Artificial Sequence
  synthetic [barcode part1]
cctcctatagacttag

SEQ ID NO: 35872 - DNA, 16 bp, Artificial Sequence
  synthetic [barcode part1]
gcggcgtaactaatct

SEQ ID NO: 35873 - DNA, 16 bp, Artificial Sequence
  synthetic [barcode part1]
ccgttcacgtcgtaac

SEQ ID NO: 35874 - DNA, 16 bp, Artificial Sequence
  synthetic [barcode part1]
attgattggtcggtcg

SEQ ID NO: 35875 - DNA, 16 bp, Artificial Sequence
  synthetic [barcode part1]
tgaggacagatacgag

SEQ ID NO: 35876 - DNA, 16 bp, Artificial Sequence
  synthetic [barcode part1]
atctagaactccacct

SEQ ID NO: 35877 - DNA, 16 bp, Artificial Sequence
  synthetic [barcode part1]
cgacgtggaagtgatc

SEQ ID NO: 35878 - DNA, 16 bp, Artificial Sequence
  synthetic [barcode part1]
acacacgataccacgt

SEQ ID NO: 35879 - DNA, 16 bp, Artificial Sequence
  synthetic [barcode part1]
aggtgaacgttacagt

SEQ ID NO: 35880 - DNA, 16 bp, Artificial Sequence
  synthetic [barcode part1]
caccagaataaggact

SEQ ID NO: 35881 - DNA, 16 bp, Artificial Sequence
  synthetic [barcode part1]
actgagttcgcacctc

SEQ ID NO: 35882 - DNA, 16 bp, Artificial Sequence
  synthetic [barcode part1]
cctcgttcactacttg

SEQ ID NO: 35883 - DNA, 16 bp, Artificial Sequence
  synthetic [barcode part1]
aacaccaacgttgcac

SEQ ID NO: 35884 - DNA, 16 bp, Artificial Sequence
  synthetic [barcode part1]
tatactctgaaccacc

SEQ ID NO: 35885 - DNA, 16 bp, Artificial Sequence
  synthetic [barcode part1]
gactcggtgattcaac

SEQ ID NO: 35886 - DNA, 16 bp, Artificial Sequence
  synthetic [barcode part1]
caacactacaacgtcg

SEQ ID NO: 35887 - DNA, 16 bp, Artificial Sequence
  synthetic [barcode part1]
atccgaacgaacactc

SEQ ID NO: 35888 - DNA, 16 bp, Artificial Sequence
  synthetic [barcode part1]
gcgtccaacaacgaag

SEQ ID NO: 35889 - DNA, 16 bp, Artificial Sequence
  synthetic [barcode part1]
cacaatcaactacgcg

SEQ ID NO: 35890 - DNA, 16 bp, Artificial Sequence
  synthetic [barcode part1]
ttggtagttacgtctc

SEQ ID NO: 35891 - DNA, 16 bp, Artificial Sequence
  synthetic [barcode part1]
cgtaacgcacctacct

SEQ ID NO: 35892 - DNA, 16 bp, Artificial Sequence
  synthetic [barcode part1]
ttggtcactaggactg

SEQ ID NO: 35893 - DNA, 16 bp, Artificial Sequence
  synthetic [barcode part1]
ttccacacgatagtct

SEQ ID NO: 35894 - DNA, 16 bp, Artificial Sequence
  synthetic [barcode part1]
cgaaccacgatctagt

SEQ ID NO: 35895 - DNA, 16 bp, Artificial Sequence
  synthetic [barcode part1]
tgttcagacgtagtcg

SEQ ID NO: 35896 - DNA, 16 bp, Artificial Sequence
  synthetic [barcode part1]
caacaacaaccgttgc

SEQ ID NO: 35897 - DNA, 16 bp, Artificial Sequence
  synthetic [barcode part1]
cacgtctgtaaggatc

SEQ ID NO: 35898 - DNA, 16 bp, Artificial Sequence
  synthetic [barcode part1]
gccagatataggagtt

SEQ ID NO: 35899 - DNA, 16 bp, Artificial Sequence
  synthetic [barcode part1]
tctgtgcaccgttgac

SEQ ID NO: 35900 - DNA, 16 bp, Artificial Sequence
  synthetic [barcode part1]
aggataaggcgtctgc

SEQ ID NO: 35901 - DNA, 16 bp, Artificial Sequence
  synthetic [barcode part1]
tccggtcagagaatct

SEQ ID NO: 35902 - DNA, 16 bp, Artificial Sequence
  synthetic [barcode part1]
tacaacacctatccgt

SEQ ID NO: 35903 - DNA, 16 bp, Artificial Sequence
  synthetic [barcode part1]
tctcacaggttcaact

SEQ ID NO: 35904 - DNA, 16 bp, Artificial Sequence
  synthetic [barcode part1]
tgttgcagtgtacacg

SEQ ID NO: 35905 - DNA, 16 bp, Artificial Sequence
  synthetic [barcode part1]
tactaggtcgcacctc

SEQ ID NO: 35906 - DNA, 16 bp, Artificial Sequence
  synthetic [barcode part1]
gcaatcacgcaattgc

SEQ ID NO: 35907 - DNA, 16 bp, Artificial Sequence
  synthetic [barcode part1]
gcgcggtaacttcctt

SEQ ID NO: 35908 - DNA, 16 bp, Artificial Sequence
  synthetic [barcode part1]
tacttgtattccggac

SEQ ID NO: 35909 - DNA, 16 bp, Artificial Sequence
  synthetic [barcode part1]
gtgcaactcgacctct

SEQ ID NO: 35910 - DNA, 16 bp, Artificial Sequence
  synthetic [barcode part1]
tcgaactacgcaggag

SEQ ID NO: 35911 - DNA, 16 bp, Artificial Sequence
  synthetic [barcode part1]
cactcaatacagaccg

SEQ ID NO: 35912 - DNA, 16 bp, Artificial Sequence
  synthetic [barcode part1]
gtggtacggttagtct

SEQ ID NO: 35913 - DNA, 16 bp, Artificial Sequence
  synthetic [barcode part1]
cgaagacaggtcactg

SEQ ID NO: 35914 - DNA, 16 bp, Artificial Sequence
  synthetic [barcode part1]
tgtcggacactgaact

SEQ ID NO: 35915 - DNA, 16 bp, Artificial Sequence
  synthetic [barcode part1]
ccacagattgtgtggt

SEQ ID NO: 35916 - DNA, 16 bp, Artificial Sequence
  synthetic [barcode part1]
cctagtcttctagtcc

SEQ ID NO: 35917 - DNA, 16 bp, Artificial Sequence
  synthetic [barcode part1]
tggcagttcttacgtt

SEQ ID NO: 35918 - DNA, 16 bp, Artificial Sequence
  synthetic [barcode part1]
tggtcaatctctcctc

SEQ ID NO: 35919 - DNA, 16 bp, Artificial Sequence
  synthetic [barcode part1]
aggacgttcttgtgtg

SEQ ID NO: 35920 - DNA, 16 bp, Artificial Sequence
  synthetic [barcode part1]
gttgtaaccgcctatt

SEQ ID NO: 35921 - DNA, 16 bp, Artificial Sequence
  synthetic [barcode part1]
tgtctccttaagtcag

SEQ ID NO: 35922 - DNA, 16 bp, Artificial Sequence
  synthetic [barcode part1]
ccgattcttgtacggc

SEQ ID NO: 35923 - DNA, 16 bp, Artificial Sequence
  synthetic [barcode part1]
cgtgttaccgattccg

SEQ ID NO: 35924 - DNA, 16 bp, Artificial Sequence
  synthetic [barcode part1]
cagactaggtctgatc

SEQ ID NO: 35925 - DNA, 16 bp, Artificial Sequence
  synthetic [barcode part1]
gttgaggaccaacgtg

SEQ ID NO: 35926 - DNA, 16 bp, Artificial Sequence
  synthetic [barcode part1]
tacctaggaggaccag

SEQ ID NO: 35927 - DNA, 16 bp, Artificial Sequence
  synthetic [barcode part1]
tagtccaggtgatctg

SEQ ID NO: 35928 - DNA, 16 bp, Artificial Sequence
  synthetic [barcode part1]
ataatacgcgttgcgc

SEQ ID NO: 35929 - DNA, 16 bp, Artificial Sequence
  synthetic [barcode part1]
ttgttcggcagacagt

SEQ ID NO: 35930 - DNA, 16 bp, Artificial Sequence
  synthetic [barcode part1]
aaccaggttatcgtcg

SEQ ID NO: 35931 - DNA, 16 bp, Artificial Sequence
  synthetic [barcode part1]
tcgcagacagaggact

SEQ ID NO: 35932 - DNA, 16 bp, Artificial Sequence
  synthetic [barcode part1]
aatctctctaacgtgc

SEQ ID NO: 35933 - DNA, 16 bp, Artificial Sequence
  synthetic [barcode part1]
aattcctctaacgcac

SEQ ID NO: 35934 - DNA, 16 bp, Artificial Sequence
  synthetic [barcode part1]
atcaacctgtgacacg

SEQ ID NO: 35935 - DNA, 16 bp, Artificial Sequence
  synthetic [barcode part1]
gaggatacgagagtgt

SEQ ID NO: 35936 - DNA, 16 bp, Artificial Sequence
  synthetic [barcode part1]
tggcaatcacgaggac

SEQ ID NO: 35937 - DNA, 16 bp, Artificial Sequence
  synthetic [barcode part1]
gttataaccactcacc

SEQ ID NO: 35938 - DNA, 16 bp, Artificial Sequence
  synthetic [barcode part1]
gagacacttaacagtg

SEQ ID NO: 35939 - DNA, 16 bp, Artificial Sequence
  synthetic [barcode part1]
tgcgttctctggcaac

SEQ ID NO: 35940 - DNA, 16 bp, Artificial Sequence
  synthetic [barcode part1]
gattaaggtaatcgcg

SEQ ID NO: 35941 - DNA, 16 bp, Artificial Sequence
  synthetic [barcode part1]
acttatcagtgttgcc

SEQ ID NO: 35942 - DNA, 16 bp, Artificial Sequence
  synthetic [barcode part1]
agtgtcggaaggaagt

SEQ ID NO: 35943 - DNA, 16 bp, Artificial Sequence
  synthetic [barcode part1]
tctattgtcaagtgcc

SEQ ID NO: 35944 - DNA, 16 bp, Artificial Sequence
  synthetic [barcode part1]
tcactgtgcgaatctt

SEQ ID NO: 35945 - DNA, 16 bp, Artificial Sequence
  synthetic [barcode part1]
gcaatcaccgatctcc

SEQ ID NO: 35946 - DNA, 16 bp, Artificial Sequence
  synthetic [barcode part1]
cgtaacgtactcactt

SEQ ID NO: 35947 - DNA, 16 bp, Artificial Sequence
  synthetic [barcode part1]
cacttaccaagacctt

SEQ ID NO: 35948 - DNA, 16 bp, Artificial Sequence
  synthetic [barcode part1]
gcaatactcctaggac

SEQ ID NO: 35949 - DNA, 16 bp, Artificial Sequence
  synthetic [barcode part1]
gcgaagaggttgtcac

SEQ ID NO: 35950 - DNA, 16 bp, Artificial Sequence
  synthetic [barcode part1]
agtcgatactgatcgc

SEQ ID NO: 35951 - DNA, 16 bp, Artificial Sequence
  synthetic [barcode part1]
ccagacctgatagttg

SEQ ID NO: 35952 - DNA, 16 bp, Artificial Sequence
  synthetic [barcode part1]
ccgaagtgtggtatct

SEQ ID NO: 35953 - DNA, 16 bp, Artificial Sequence
  synthetic [barcode part1]
ttagttctaagtccgc

SEQ ID NO: 35954 - DNA, 16 bp, Artificial Sequence
  synthetic [barcode part1]
tacgatcacactcgag

SEQ ID NO: 35955 - DNA, 16 bp, Artificial Sequence
  synthetic [barcode part1]
tcgtaacttaggaccg

SEQ ID NO: 35956 - DNA, 16 bp, Artificial Sequence
  synthetic [barcode part1]
tgaaccacgcgtcttc

SEQ ID NO: 35957 - DNA, 16 bp, Artificial Sequence
  synthetic [barcode part1]
cgacaacctagatcgt

SEQ ID NO: 35958 - DNA, 16 bp, Artificial Sequence
  synthetic [barcode part1]
aaggtagagtgttcgt

SEQ ID NO: 35959 - DNA, 16 bp, Artificial Sequence
  synthetic [barcode part1]
attcgtcgtaggtggt

SEQ ID NO: 35960 - DNA, 16 bp, Artificial Sequence
  synthetic [barcode part1]
gaccgtaagaagatct

SEQ ID NO: 35961 - DNA, 16 bp, Artificial Sequence
  synthetic [barcode part1]
actctatcgaatccac

SEQ ID NO: 35962 - DNA, 16 bp, Artificial Sequence
  synthetic [barcode part1]
tgccgccagatattcc

SEQ ID NO: 35963 - DNA, 16 bp, Artificial Sequence
  synthetic [barcode part1]
agtgatcctgaaccac

SEQ ID NO: 35964 - DNA, 16 bp, Artificial Sequence
  synthetic [barcode part1]
tgagaattcgttggag

SEQ ID NO: 35965 - DNA, 16 bp, Artificial Sequence
  synthetic [barcode part1]
gtaccagaggaattgt

SEQ ID NO: 35966 - DNA, 16 bp, Artificial Sequence
  synthetic [barcode part1]
aattcaaggtcgccac

SEQ ID NO: 35967 - DNA, 16 bp, Artificial Sequence
  synthetic [barcode part1]
atctgtgtcttcagtg

SEQ ID NO: 35968 - DNA, 16 bp, Artificial Sequence
  synthetic [barcode part1]
ccaactactggaatcg

SEQ ID NO: 35969 - DNA, 16 bp, Artificial Sequence
  synthetic [barcode part1]
gtgaattcctcactgt

SEQ ID NO: 35970 - DNA, 16 bp, Artificial Sequence
  synthetic [barcode part1]
tctgcgccagtgatct

SEQ ID NO: 35971 - DNA, 16 bp, Artificial Sequence
  synthetic [barcode part1]
gtcgagaatactaacg

SEQ ID NO: 35972 - DNA, 16 bp, Artificial Sequence
  synthetic [barcode part1]
agaatcaggtccgcag

SEQ ID NO: 35973 - DNA, 16 bp, Artificial Sequence
  synthetic [barcode part1]
attcactaacaccacc

SEQ ID NO: 35974 - DNA, 16 bp, Artificial Sequence
  synthetic [barcode part1]
cctatatagtcgtcac

SEQ ID NO: 35975 - DNA, 16 bp, Artificial Sequence
  synthetic [barcode part1]
cacagttactaccttg

SEQ ID NO: 35976 - DNA, 16 bp, Artificial Sequence
  synthetic [barcode part1]
agttgaagtggtcgcg

SEQ ID NO: 35977 - DNA, 16 bp, Artificial Sequence
  synthetic [barcode part1]
gtatacgactggttgc

SEQ ID NO: 35978 - DNA, 16 bp, Artificial Sequence
  synthetic [barcode part1]
accagagaacttcctg

SEQ ID NO: 35979 - DNA, 16 bp, Artificial Sequence
  synthetic [barcode part1]
ttgcctcgatctatag

SEQ ID NO: 35980 - DNA, 16 bp, Artificial Sequence
  synthetic [barcode part1]
gcaccaggagacaatc

SEQ ID NO: 35981 - DNA, 16 bp, Artificial Sequence
  synthetic [barcode part1]
cgtgtagtggaagatt

SEQ ID NO: 35982 - DNA, 16 bp, Artificial Sequence
  synthetic [barcode part1]
tgtgagtaggtctgtc

SEQ ID NO: 35983 - DNA, 16 bp, Artificial Sequence
  synthetic [barcode part1]
cggatatcctcaccac

SEQ ID NO: 35984 - DNA, 16 bp, Artificial Sequence
  synthetic [barcode part1]
ttgcagatccgtagac

SEQ ID NO: 35985 - DNA, 16 bp, Artificial Sequence
  synthetic [barcode part1]
cctcgtgtggcaatct

SEQ ID NO: 35986 - DNA, 16 bp, Artificial Sequence
  synthetic [barcode part1]
gcagtcgtcaacttcc

SEQ ID NO: 35987 - DNA, 16 bp, Artificial Sequence
  synthetic [barcode part1]
tcgaacggaacctact

SEQ ID NO: 35988 - DNA, 16 bp, Artificial Sequence
  synthetic [barcode part1]
cgacctcaccaacgtt

SEQ ID NO: 35989 - DNA, 16 bp, Artificial Sequence
  synthetic [barcode part1]
gtagttgatcggtacc

SEQ ID NO: 35990 - DNA, 16 bp, Artificial Sequence
  synthetic [barcode part1]
agttaacaccggtcgt

SEQ ID NO: 35991 - DNA, 16 bp, Artificial Sequence
  synthetic [barcode part1]
cacggatctgccttgt

SEQ ID NO: 35992 - DNA, 16 bp, Artificial Sequence
  synthetic [barcode part1]
gcgatcgagaaggttc

SEQ ID NO: 35993 - DNA, 16 bp, Artificial Sequence
  synthetic [barcode part1]
tgtcagtacacaccag

SEQ ID NO: 35994 - DNA, 16 bp, Artificial Sequence
  synthetic [barcode part1]
gacgtagagtgacctg

SEQ ID NO: 35995 - DNA, 16 bp, Artificial Sequence
  synthetic [barcode part1]
gttgactagtcggttg

SEQ ID NO: 35996 - DNA, 16 bp, Artificial Sequence
  synthetic [barcode part1]
gcgtgtcctcaatctg

SEQ ID NO: 35997 - DNA, 16 bp, Artificial Sequence
  synthetic [barcode part1]
gattaccacctggtag

SEQ ID NO: 35998 - DNA, 16 bp, Artificial Sequence
  synthetic [barcode part1]
tgtctaggtcacctcg

SEQ ID NO: 35999 - DNA, 16 bp, Artificial Sequence
  synthetic [barcode part1]
gacgaacagtgtcgtg

SEQ ID NO: 36000 - DNA, 16 bp, Artificial Sequence
  synthetic [barcode part1]
acgtaggttgtactcg

SEQ ID NO: 36001 - DNA, 16 bp, Artificial Sequence
  synthetic [barcode part1]
agaattgtctcgccag

SEQ ID NO: 36002 - DNA, 16 bp, Artificial Sequence
  synthetic [barcode part1]
acgtgagttgttagag

SEQ ID NO: 36003 - DNA, 16 bp, Artificial Sequence
  synthetic [barcode part1]
ttggtgaaggtacggc

SEQ ID NO: 36004 - DNA, 16 bp, Artificial Sequence
  synthetic [barcode part1]
gtacctatcacttcag

SEQ ID NO: 36005 - DNA, 16 bp, Artificial Sequence
  synthetic [barcode part1]
attatcctgtccgaac

SEQ ID NO: 36006 - DNA, 16 bp, Artificial Sequence
  synthetic [barcode part1]
ttacgtggaccgagag

SEQ ID NO: 36007 - DNA, 16 bp, Artificial Sequence
  synthetic [barcode part1]
tcctctcgtattgcgt

SEQ ID NO: 36008 - DNA, 16 bp, Artificial Sequence
  synthetic [barcode part1]
aataggattgacgtgc

SEQ ID NO: 36009 - DNA, 16 bp, Artificial Sequence
  synthetic [barcode part1]
tatattggtcggcgtg

SEQ ID NO: 36010 - DNA, 16 bp, Artificial Sequence
  synthetic [barcode part1]
tgatagacaggtactg

SEQ ID NO: 36011 - DNA, 16 bp, Artificial Sequence
  synthetic [barcode part1]
caactctgcacaccgt

SEQ ID NO: 36012 - DNA, 16 bp, Artificial Sequence
  synthetic [barcode part1]
gtgttagtcggtacac

SEQ ID NO: 36013 - DNA, 16 bp, Artificial Sequence
  synthetic [barcode part1]
gaggaactggaagatc

SEQ ID NO: 36014 - DNA, 16 bp, Artificial Sequence
  synthetic [barcode part1]
ttctccgatctggacg

SEQ ID NO: 36015 - DNA, 16 bp, Artificial Sequence
  synthetic [barcode part1]
gacttcaacttactcg

SEQ ID NO: 36016 - DNA, 16 bp, Artificial Sequence
  synthetic [barcode part1]
cgagtatcgtgagttc

SEQ ID NO: 36017 - DNA, 16 bp, Artificial Sequence
  synthetic [barcode part1]
gtgaactgaagatcac

SEQ ID NO: 36018 - DNA, 16 bp, Artificial Sequence
  synthetic [barcode part1]
gttgtacagtcgtacg

SEQ ID NO: 36019 - DNA, 16 bp, Artificial Sequence
  synthetic [barcode part1]
cagattggtataggac

SEQ ID NO: 36020 - DNA, 16 bp, Artificial Sequence
  synthetic [barcode part1]
actcgcctagaatctt

SEQ ID NO: 36021 - DNA, 16 bp, Artificial Sequence
  synthetic [barcode part1]
cagttctcaacgtgtt

SEQ ID NO: 36022 - DNA, 16 bp, Artificial Sequence
  synthetic [barcode part1]
agttattgtctccgtg

SEQ ID NO: 36023 - DNA, 16 bp, Artificial Sequence
  synthetic [barcode part1]
atctacgatcgtcttg

SEQ ID NO: 36024 - DNA, 16 bp, Artificial Sequence
  synthetic [barcode part1]
tagacctcggatatcg

SEQ ID NO: 36025 - DNA, 16 bp, Artificial Sequence
  synthetic [barcode part1]
acaactgcctcctgac

SEQ ID NO: 36026 - DNA, 16 bp, Artificial Sequence
  synthetic [barcode part1]
tctcgtgaatctgatc

SEQ ID NO: 36027 - DNA, 16 bp, Artificial Sequence
  synthetic [barcode part1]
cgagtcacctcgtgtt

SEQ ID NO: 36028 - DNA, 16 bp, Artificial Sequence
  synthetic [barcode part1]
attgcgaagatcctgc

SEQ ID NO: 36029 - DNA, 16 bp, Artificial Sequence
  synthetic [barcode part1]
tccactcgaatcttag

SEQ ID NO: 36030 - DNA, 16 bp, Artificial Sequence
  synthetic [barcode part1]
attccgtctcgatcct

SEQ ID NO: 36031 - DNA, 16 bp, Artificial Sequence
  synthetic [barcode part1]
atagttactggccttc

SEQ ID NO: 36032 - DNA, 16 bp, Artificial Sequence
  synthetic [barcode part1]
caccgccaacaataac

SEQ ID NO: 36033 - DNA, 16 bp, Artificial Sequence
  synthetic [barcode part1]
taggaggtacgtaatc

SEQ ID NO: 36034 - DNA, 16 bp, Artificial Sequence
  synthetic [barcode part1]
tctcctgataattgcg

SEQ ID NO: 36035 - DNA, 16 bp, Artificial Sequence
  synthetic [barcode part1]
gtactccgtcactgac

SEQ ID NO: 36036 - DNA, 16 bp, Artificial Sequence
  synthetic [barcode part1]
gtcaggagtcgtgtag

SEQ ID NO: 36037 - DNA, 16 bp, Artificial Sequence
  synthetic [barcode part1]
agtctggcgcagaagt

SEQ ID NO: 36038 - DNA, 16 bp, Artificial Sequence
  synthetic [barcode part1]
gtcactaccgagttag

SEQ ID NO: 36039 - DNA, 16 bp, Artificial Sequence
  synthetic [barcode part1]
tacgacactcggaatc

SEQ ID NO: 36040 - DNA, 16 bp, Artificial Sequence
  synthetic [barcode part1]
ttctgagttacctacg

SEQ ID NO: 36041 - DNA, 16 bp, Artificial Sequence
  synthetic [barcode part1]
gcggccagttaatact

SEQ ID NO: 36042 - DNA, 16 bp, Artificial Sequence
  synthetic [barcode part1]
acaacggagatattcg

SEQ ID NO: 36043 - DNA, 16 bp, Artificial Sequence
  synthetic [barcode part1]
accggtaaggtatcct

SEQ ID NO: 36044 - DNA, 16 bp, Artificial Sequence
  synthetic [barcode part1]
aacgtgtatatcggcc

SEQ ID NO: 36045 - DNA, 16 bp, Artificial Sequence
  synthetic [barcode part1]
agtgtgttacgcgatc

SEQ ID NO: 36046 - DNA, 16 bp, Artificial Sequence
  synthetic [barcode part1]
agtcgagttgcacgag

SEQ ID NO: 36047 - DNA, 16 bp, Artificial Sequence
  synthetic [barcode part1]
tcttaggccacagtag

SEQ ID NO: 36048 - DNA, 16 bp, Artificial Sequence
  synthetic [barcode part1]
tgatcgtctcaatctg

SEQ ID NO: 36049 - DNA, 16 bp, Artificial Sequence
  synthetic [barcode part1]
tgtcgtccgaattcgc

SEQ ID NO: 36050 - DNA, 16 bp, Artificial Sequence
  synthetic [barcode part1]
accgaactgaggacgt

SEQ ID NO: 36051 - DNA, 16 bp, Artificial Sequence
  synthetic [barcode part1]
gaattcactgccactt

SEQ ID NO: 36052 - DNA, 16 bp, Artificial Sequence
  synthetic [barcode part1]
gtagtacttggttggc

SEQ ID NO: 36053 - DNA, 16 bp, Artificial Sequence
  synthetic [barcode part1]
acaacgttgcagtgtc

SEQ ID NO: 36054 - DNA, 16 bp, Artificial Sequence
  synthetic [barcode part1]
ttcacgcagttgtcgc

SEQ ID NO: 36055 - DNA, 16 bp, Artificial Sequence
  synthetic [barcode part1]
tcaacagatctctacc

SEQ ID NO: 36056 - DNA, 16 bp, Artificial Sequence
  synthetic [barcode part1]
aggcgatctagtatag

SEQ ID NO: 36057 - DNA, 16 bp, Artificial Sequence
  synthetic [barcode part1]
aaccacgccgaagagt

SEQ ID NO: 36058 - DNA, 16 bp, Artificial Sequence
  synthetic [barcode part1]
aagtagtgcgtctaag

SEQ ID NO: 36059 - DNA, 16 bp, Artificial Sequence
  synthetic [barcode part1]
caccacgagttgattg

SEQ ID NO: 36060 - DNA, 16 bp, Artificial Sequence
  synthetic [barcode part1]
gcaacgtctccttctt

SEQ ID NO: 36061 - DNA, 16 bp, Artificial Sequence
  synthetic [barcode part1]
cgcctccactgaattg

SEQ ID NO: 36062 - DNA, 16 bp, Artificial Sequence
  synthetic [barcode part1]
taatccttctcggtcc

SEQ ID NO: 36063 - DNA, 16 bp, Artificial Sequence
  synthetic [barcode part1]
agtgtaagtctctgcg

SEQ ID NO: 36064 - DNA, 16 bp, Artificial Sequence
  synthetic [barcode part1]
cgagagagtattaacc

SEQ ID NO: 36065 - DNA, 16 bp, Artificial Sequence
  synthetic [barcode part1]
gaatcggtgatcgcag

SEQ ID NO: 36066 - DNA, 16 bp, Artificial Sequence
  synthetic [barcode part1]
aggacttggatcctac

SEQ ID NO: 36067 - DNA, 16 bp, Artificial Sequence
  synthetic [barcode part1]
acaaccacgcgattac

SEQ ID NO: 36068 - DNA, 16 bp, Artificial Sequence
  synthetic [barcode part1]
gcaagagtaacctggc

SEQ ID NO: 36069 - DNA, 16 bp, Artificial Sequence
  synthetic [barcode part1]
gtctgtacgactcctg

SEQ ID NO: 36070 - DNA, 16 bp, Artificial Sequence
  synthetic [barcode part1]
tagagatctactggag

SEQ ID NO: 36071 - DNA, 16 bp, Artificial Sequence
  synthetic [barcode part1]
gtataacctggtcctt

SEQ ID NO: 36072 - DNA, 16 bp, Artificial Sequence
  synthetic [barcode part1]
atagagtcgaacactg

SEQ ID NO: 36073 - DNA, 16 bp, Artificial Sequence
  synthetic [barcode part1]
tacgcgaacggagtgt

SEQ ID NO: 36074 - DNA, 16 bp, Artificial Sequence
  synthetic [barcode part1]
atcctcctggtacacg

SEQ ID NO: 36075 - DNA, 16 bp, Artificial Sequence
  synthetic [barcode part1]
aatccggaccagatct

SEQ ID NO: 36076 - DNA, 16 bp, Artificial Sequence
  synthetic [barcode part1]
tacctgattcttgacg

SEQ ID NO: 36077 - DNA, 16 bp, Artificial Sequence
  synthetic [barcode part1]
gttgccgtcttgtacg

SEQ ID NO: 36078 - DNA, 16 bp, Artificial Sequence
  synthetic [barcode part1]
tggtcaggtgtacact

SEQ ID NO: 36079 - DNA, 16 bp, Artificial Sequence
  synthetic [barcode part1]
actggtgtattccact

SEQ ID NO: 36080 - DNA, 16 bp, Artificial Sequence
  synthetic [barcode part1]
cagatcgcacaggagt

SEQ ID NO: 36081 - DNA, 16 bp, Artificial Sequence
  synthetic [barcode part1]
gtctccgtgagttatt

SEQ ID NO: 36082 - DNA, 16 bp, Artificial Sequence
  synthetic [barcode part1]
actcgtacacagactg

SEQ ID NO: 36083 - DNA, 16 bp, Artificial Sequence
  synthetic [barcode part1]
cgcaataacagacggc

SEQ ID NO: 36084 - DNA, 16 bp, Artificial Sequence
  synthetic [barcode part1]
tgccttcagttgttag

SEQ ID NO: 36085 - DNA, 16 bp, Artificial Sequence
  synthetic [barcode part1]
attgcggcctgaagtt

SEQ ID NO: 36086 - DNA, 16 bp, Artificial Sequence
  synthetic [barcode part1]
gtacaactacggtcac

SEQ ID NO: 36087 - DNA, 16 bp, Artificial Sequence
  synthetic [barcode part1]
gttcgaggaatccgtt

SEQ ID NO: 36088 - DNA, 16 bp, Artificial Sequence
  synthetic [barcode part1]
tcctcttcgtaacacc

SEQ ID NO: 36089 - DNA, 16 bp, Artificial Sequence
  synthetic [barcode part1]
acgactataacgcgtc

SEQ ID NO: 36090 - DNA, 16 bp, Artificial Sequence
  synthetic [barcode part1]
tggtaggtaggcactg

SEQ ID NO: 36091 - DNA, 16 bp, Artificial Sequence
  synthetic [barcode part1]
attgaagaccgatacg

SEQ ID NO: 36092 - DNA, 16 bp, Artificial Sequence
  synthetic [barcode part1]
cgtatccacaattcac

SEQ ID NO: 36093 - DNA, 16 bp, Artificial Sequence
  synthetic [barcode part1]
gaaggtggtaacttac

SEQ ID NO: 36094 - DNA, 16 bp, Artificial Sequence
  synthetic [barcode part1]
tgatccaaggcacgag

SEQ ID NO: 36095 - DNA, 16 bp, Artificial Sequence
  synthetic [barcode part1]
cctcagttacggactc

SEQ ID NO: 36096 - DNA, 16 bp, Artificial Sequence
  synthetic [barcode part1]
tgcgccttgccagatt

SEQ ID NO: 36097 - DNA, 16 bp, Artificial Sequence
  synthetic [barcode part1]
tgtcaacaccagtacg

SEQ ID NO: 36098 - DNA, 16 bp, Artificial Sequence
  synthetic [barcode part1]
aggcggattataacgt

SEQ ID NO: 36099 - DNA, 16 bp, Artificial Sequence
  synthetic [barcode part1]
ttcgtatcggtaatcc

SEQ ID NO: 36100 - DNA, 16 bp, Artificial Sequence
  synthetic [barcode part1]
ccgagaagactgtacg

SEQ ID NO: 36101 - DNA, 16 bp, Artificial Sequence
  synthetic [barcode part1]
taacgactccttgtac

SEQ ID NO: 36102 - DNA, 16 bp, Artificial Sequence
  synthetic [barcode part1]
ccaagtaatccacgac

SEQ ID NO: 36103 - DNA, 16 bp, Artificial Sequence
  synthetic [barcode part1]
ttgacgttcttgactg

SEQ ID NO: 36104 - DNA, 16 bp, Artificial Sequence
  synthetic [barcode part1]
gtactactacctgttg

SEQ ID NO: 36105 - DNA, 16 bp, Artificial Sequence
  synthetic [barcode part1]
gagtggtgttgagaag

SEQ ID NO: 36106 - DNA, 16 bp, Artificial Sequence
  synthetic [barcode part1]
gacctgcaggtgatag

SEQ ID NO: 36107 - DNA, 16 bp, Artificial Sequence
  synthetic [barcode part1]
tcgtcacgttcgcaac

SEQ ID NO: 36108 - DNA, 16 bp, Artificial Sequence
  synthetic [barcode part1]
tagtcagatcgactgc

SEQ ID NO: 36109 - DNA, 16 bp, Artificial Sequence
  synthetic [barcode part1]
actctgcagacactcc

SEQ ID NO: 36110 - DNA, 16 bp, Artificial Sequence
  synthetic [barcode part1]
gtaactaccgatcctt

SEQ ID NO: 36111 - DNA, 16 bp, Artificial Sequence
  synthetic [barcode part1]
gtatacgcaacgtcac

SEQ ID NO: 36112 - DNA, 16 bp, Artificial Sequence
  synthetic [barcode part1]
atccactcgagtgagt

SEQ ID NO: 36113 - DNA, 16 bp, Artificial Sequence
  synthetic [barcode part1]
agaagttaccggcgtg

SEQ ID NO: 36114 - DNA, 16 bp, Artificial Sequence
  synthetic [barcode part1]
tgatctgttcgcaccg

SEQ ID NO: 36115 - DNA, 16 bp, Artificial Sequence
  synthetic [barcode part1]
gtaccgaacgcaactt

SEQ ID NO: 36116 - DNA, 16 bp, Artificial Sequence
  synthetic [barcode part1]
aggaattactgacgtg

SEQ ID NO: 36117 - DNA, 16 bp, Artificial Sequence
  synthetic [barcode part1]
actccactaggcctac

SEQ ID NO: 36118 - DNA, 16 bp, Artificial Sequence
  synthetic [barcode part1]
cacgagacggttcaag

SEQ ID NO: 36119 - DNA, 16 bp, Artificial Sequence
  synthetic [barcode part1]
gcactagacgtgatct

SEQ ID NO: 36120 - DNA, 16 bp, Artificial Sequence
  synthetic [barcode part1]
gaacttgacggaacgc

SEQ ID NO: 36121 - DNA, 16 bp, Artificial Sequence
  synthetic [barcode part1]
cgtgtggacctcttac

SEQ ID NO: 36122 - DNA, 16 bp, Artificial Sequence
  synthetic [barcode part1]
aacctagaattcggcc

SEQ ID NO: 36123 - DNA, 16 bp, Artificial Sequence
  synthetic [barcode part1]
gcaagttaatccgtgc

SEQ ID NO: 36124 - DNA, 16 bp, Artificial Sequence
  synthetic [barcode part1]
cctggtgagtacgaag

SEQ ID NO: 36125 - DNA, 16 bp, Artificial Sequence
  synthetic [barcode part1]
ttaagacgcctactct

SEQ ID NO: 36126 - DNA, 16 bp, Artificial Sequence
  synthetic [barcode part1]
tacgttccttgacagt

SEQ ID NO: 36127 - DNA, 16 bp, Artificial Sequence
  synthetic [barcode part1]
tggtcgagttgtggtt

SEQ ID NO: 36128 - DNA, 16 bp, Artificial Sequence
  synthetic [barcode part1]
acgatctaggtgtaag

SEQ ID NO: 36129 - DNA, 16 bp, Artificial Sequence
  synthetic [barcode part1]
cctaattcaacacgtc

SEQ ID NO: 36130 - DNA, 16 bp, Artificial Sequence
  synthetic [barcode part1]
caattggaaccggttc

SEQ ID NO: 36131 - DNA, 16 bp, Artificial Sequence
  synthetic [barcode part1]
tgaggcaactcaggtg

SEQ ID NO: 36132 - DNA, 16 bp, Artificial Sequence
  synthetic [barcode part1]
taagagtgaaccgttg

SEQ ID NO: 36133 - DNA, 16 bp, Artificial Sequence
  synthetic [barcode part1]
agataggaggtcttgt

SEQ ID NO: 36134 - DNA, 16 bp, Artificial Sequence
  synthetic [barcode part1]
cgtgaataagtaacgc

SEQ ID NO: 36135 - DNA, 16 bp, Artificial Sequence
  synthetic [barcode part1]
gtactccgttgtcgac

SEQ ID NO: 36136 - DNA, 16 bp, Artificial Sequence
  synthetic [barcode part1]
atcacgaacttcaggc

SEQ ID NO: 36137 - DNA, 16 bp, Artificial Sequence
  synthetic [barcode part1]
cgaacgtacacttggt

SEQ ID NO: 36138 - DNA, 16 bp, Artificial Sequence
  synthetic [barcode part1]
tctcggcgactgtact

SEQ ID NO: 36139 - DNA, 16 bp, Artificial Sequence
  synthetic [barcode part1]
tgcaggagttaggtcg

SEQ ID NO: 36140 - DNA, 16 bp, Artificial Sequence
  synthetic [barcode part1]
aacagtctacgagaac

SEQ ID NO: 36141 - DNA, 16 bp, Artificial Sequence
  synthetic [barcode part1]
ttacacgcgactacag

SEQ ID NO: 36142 - DNA, 16 bp, Artificial Sequence
  synthetic [barcode part1]
caggcaacaccgtaag

SEQ ID NO: 36143 - DNA, 16 bp, Artificial Sequence
  synthetic [barcode part1]
tggcggtaatctgatc

SEQ ID NO: 36144 - DNA, 16 bp, Artificial Sequence
  synthetic [barcode part1]
gcggttgacgttaatc

SEQ ID NO: 36145 - DNA, 16 bp, Artificial Sequence
  synthetic [barcode part1]
tgttccggaacttatc

SEQ ID NO: 36146 - DNA, 16 bp, Artificial Sequence
  synthetic [barcode part1]
cgtggtgacctacttc

SEQ ID NO: 36147 - DNA, 16 bp, Artificial Sequence
  synthetic [barcode part1]
gagtacttactcggac

SEQ ID NO: 36148 - DNA, 16 bp, Artificial Sequence
  synthetic [barcode part1]
tctgtgtgttgtcagt

SEQ ID NO: 36149 - DNA, 16 bp, Artificial Sequence
  synthetic [barcode part1]
tcgtaacaggattccg

SEQ ID NO: 36150 - DNA, 16 bp, Artificial Sequence
  synthetic [barcode part1]
tagacgcgtattcggt

SEQ ID NO: 36151 - DNA, 16 bp, Artificial Sequence
  synthetic [barcode part1]
ccgcctatctggaact

SEQ ID NO: 36152 - DNA, 16 bp, Artificial Sequence
  synthetic [barcode part1]
tacgactctccaccag

SEQ ID NO: 36153 - DNA, 16 bp, Artificial Sequence
  synthetic [barcode part1]
cactcgttcacagtgc

SEQ ID NO: 36154 - DNA, 16 bp, Artificial Sequence
  synthetic [barcode part1]
cactcaagacctacag

SEQ ID NO: 36155 - DNA, 16 bp, Artificial Sequence
  synthetic [barcode part1]
agacaattgcgtcaag

SEQ ID NO: 36156 - DNA, 16 bp, Artificial Sequence
  synthetic [barcode part1]
gacaactgtatcttcc

SEQ ID NO: 36157 - DNA, 16 bp, Artificial Sequence
  synthetic [barcode part1]
gaggtcttgtctgcct

SEQ ID NO: 36158 - DNA, 16 bp, Artificial Sequence
  synthetic [barcode part1]
tgtactgtgtggtcag

SEQ ID NO: 36159 - DNA, 16 bp, Artificial Sequence
  synthetic [barcode part1]
tcttaaccgtgccgac

SEQ ID NO: 36160 - DNA, 16 bp, Artificial Sequence
  synthetic [barcode part1]
ccggtctacctagact

SEQ ID NO: 36161 - DNA, 16 bp, Artificial Sequence
  synthetic [barcode part1]
tcgtgtagtgcactag

SEQ ID NO: 36162 - DNA, 16 bp, Artificial Sequence
  synthetic [barcode part1]
gtacgtaccaactgac

SEQ ID NO: 36163 - DNA, 16 bp, Artificial Sequence
  synthetic [barcode part1]
tcgaatagtcctgtct

SEQ ID NO: 36164 - DNA, 16 bp, Artificial Sequence
  synthetic [barcode part1]
gtgtacagtcggttac

SEQ ID NO: 36165 - DNA, 16 bp, Artificial Sequence
  synthetic [barcode part1]
caacactgacgttgtg

SEQ ID NO: 36166 - DNA, 16 bp, Artificial Sequence
  synthetic [barcode part1]
actcacagttgtcttg

SEQ ID NO: 36167 - DNA, 16 bp, Artificial Sequence
  synthetic [barcode part1]
gtgttacgacactacg

SEQ ID NO: 36168 - DNA, 16 bp, Artificial Sequence
  synthetic [barcode part1]
tcttgtaggtctaacc

SEQ ID NO: 36169 - DNA, 16 bp, Artificial Sequence
  synthetic [barcode part1]
gatctggttaggtcgt

SEQ ID NO: 36170 - DNA, 16 bp, Artificial Sequence
  synthetic [barcode part1]
gatagatcactgtgag

SEQ ID NO: 36171 - DNA, 16 bp, Artificial Sequence
  synthetic [barcode part1]
tcgcacttaagaacgc

SEQ ID NO: 36172 - DNA, 16 bp, Artificial Sequence
  synthetic [barcode part1]
gcaatcaattggcacc

SEQ ID NO: 36173 - DNA, 16 bp, Artificial Sequence
  synthetic [barcode part1]
gcgaatcgagaaccgt

SEQ ID NO: 36174 - DNA, 16 bp, Artificial Sequence
  synthetic [barcode part1]
actacaactcactcgt

SEQ ID NO: 36175 - DNA, 16 bp, Artificial Sequence
  synthetic [barcode part1]
aactcttcctcgttgc

SEQ ID NO: 36176 - DNA, 16 bp, Artificial Sequence
  synthetic [barcode part1]
gtcagacttgtatcct

SEQ ID NO: 36177 - DNA, 16 bp, Artificial Sequence
  synthetic [barcode part1]
tacgaacagtgaagtc

SEQ ID NO: 36178 - DNA, 16 bp, Artificial Sequence
  synthetic [barcode part1]
gtacacggtcgcaatt

SEQ ID NO: 36179 - DNA, 16 bp, Artificial Sequence
  synthetic [barcode part1]
ttggagtagtgtcgtc

SEQ ID NO: 36180 - DNA, 16 bp, Artificial Sequence
  synthetic [barcode part1]
aacctgaacacttctc

SEQ ID NO: 36181 - DNA, 16 bp, Artificial Sequence
  synthetic [barcode part1]
atagtgaatctaggcg

SEQ ID NO: 36182 - DNA, 16 bp, Artificial Sequence
  synthetic [barcode part1]
aggccggatatcaacg

SEQ ID NO: 36183 - DNA, 16 bp, Artificial Sequence
  synthetic [barcode part1]
cggaagttcaccagag

SEQ ID NO: 36184 - DNA, 16 bp, Artificial Sequence
  synthetic [barcode part1]
cctgattcgcacgact

SEQ ID NO: 36185 - DNA, 16 bp, Artificial Sequence
  synthetic [barcode part1]
aattgcgtgtaaccgc

SEQ ID NO: 36186 - DNA, 16 bp, Artificial Sequence
  synthetic [barcode part1]
agtggttgacttggtc

SEQ ID NO: 36187 - DNA, 16 bp, Artificial Sequence
  synthetic [barcode part1]
aacggactctggaacg

SEQ ID NO: 36188 - DNA, 16 bp, Artificial Sequence
  synthetic [barcode part1]
gaataccaggcggtac

SEQ ID NO: 36189 - DNA, 16 bp, Artificial Sequence
  synthetic [barcode part1]
cgtaggtctgcgaatt

SEQ ID NO: 36190 - DNA, 16 bp, Artificial Sequence
  synthetic [barcode part1]
gagtatcttcactacc

SEQ ID NO: 36191 - DNA, 16 bp, Artificial Sequence
  synthetic [barcode part1]
acgagtctataggcct

SEQ ID NO: 36192 - DNA, 16 bp, Artificial Sequence
  synthetic [barcode part1]
aagtctcttcctcctg

SEQ ID NO: 36193 - DNA, 16 bp, Artificial Sequence
  synthetic [barcode part1]
gcaggatagacagtag

SEQ ID NO: 36194 - DNA, 16 bp, Artificial Sequence
  synthetic [barcode part1]
tccggttcgtagttgc

SEQ ID NO: 36195 - DNA, 16 bp, Artificial Sequence
  synthetic [barcode part1]
cggtcagttctaagac

SEQ ID NO: 36196 - DNA, 16 bp, Artificial Sequence
  synthetic [barcode part1]
gtccgacttagtaacg

SEQ ID NO: 36197 - DNA, 16 bp, Artificial Sequence
  synthetic [barcode part1]
acaggttgtgtccaac

SEQ ID NO: 36198 - DNA, 16 bp, Artificial Sequence
  synthetic [barcode part1]
aggtcgcggattattc

SEQ ID NO: 36199 - DNA, 16 bp, Artificial Sequence
  synthetic [barcode part1]
atatcctcgtgtcctc

SEQ ID NO: 36200 - DNA, 16 bp, Artificial Sequence
  synthetic [barcode part1]
cctaagtatccgaacg

SEQ ID NO: 36201 - DNA, 16 bp, Artificial Sequence
  synthetic [barcode part1]
tcaattcgcctagatc

SEQ ID NO: 36202 - DNA, 16 bp, Artificial Sequence
  synthetic [barcode part1]
cagagtcactgactgt

SEQ ID NO: 36203 - DNA, 16 bp, Artificial Sequence
  synthetic [barcode part1]
acctcctaggatcaag

SEQ ID NO: 36204 - DNA, 16 bp, Artificial Sequence
  synthetic [barcode part1]
agtgtctagatcgaag

SEQ ID NO: 36205 - DNA, 16 bp, Artificial Sequence
  synthetic [barcode part1]
atcacctcaggtatct

SEQ ID NO: 36206 - DNA, 16 bp, Artificial Sequence
  synthetic [barcode part1]
gtctagaaggcctatc

SEQ ID NO: 36207 - DNA, 16 bp, Artificial Sequence
  synthetic [barcode part1]
accttgacttctcctg

SEQ ID NO: 36208 - DNA, 16 bp, Artificial Sequence
  synthetic [barcode part1]
gtcgaccaactagttg

SEQ ID NO: 36209 - DNA, 16 bp, Artificial Sequence
  synthetic [barcode part1]
aattctccacgagttc

SEQ ID NO: 36210 - DNA, 16 bp, Artificial Sequence
  synthetic [barcode part1]
gtatcacaggcaggtg

SEQ ID NO: 36211 - DNA, 16 bp, Artificial Sequence
  synthetic [barcode part1]
gtgtggttgcacaact

SEQ ID NO: 36212 - DNA, 16 bp, Artificial Sequence
  synthetic [barcode part1]
gattcactgaacgtcg

SEQ ID NO: 36213 - DNA, 16 bp, Artificial Sequence
  synthetic [barcode part1]
acagagaaggacacgt

SEQ ID NO: 36214 - DNA, 16 bp, Artificial Sequence
  synthetic [barcode part1]
aagtgccaggtgacgt

SEQ ID NO: 36215 - DNA, 16 bp, Artificial Sequence
  synthetic [barcode part1]
agttcttccggacacc

SEQ ID NO: 36216 - DNA, 16 bp, Artificial Sequence
  synthetic [barcode part1]
gacaactcgcaccttc

SEQ ID NO: 36217 - DNA, 16 bp, Artificial Sequence
  synthetic [barcode part1]
gttcaccaggtcctac

SEQ ID NO: 36218 - DNA, 16 bp, Artificial Sequence
  synthetic [barcode part1]
gtccacctggaactct

SEQ ID NO: 36219 - DNA, 16 bp, Artificial Sequence
  synthetic [barcode part1]
agtagttgcacaaggt

SEQ ID NO: 36220 - DNA, 16 bp, Artificial Sequence
  synthetic [barcode part1]
taaggtcagttccgac

SEQ ID NO: 36221 - DNA, 16 bp, Artificial Sequence
  synthetic [barcode part1]
agaggacgtctgagtc

SEQ ID NO: 36222 - DNA, 16 bp, Artificial Sequence
  synthetic [barcode part1]
tgcgattcgacaggag

SEQ ID NO: 36223 - DNA, 16 bp, Artificial Sequence
  synthetic [barcode part1]
ttctggagaactccag

SEQ ID NO: 36224 - DNA, 16 bp, Artificial Sequence
  synthetic [barcode part1]
gaactacctgtacttc

SEQ ID NO: 36225 - DNA, 16 bp, Artificial Sequence
  synthetic [barcode part1]
tggtgtattgaacgcc

SEQ ID NO: 36226 - DNA, 16 bp, Artificial Sequence
  synthetic [barcode part1]
cgtcgttaacacgtcc

SEQ ID NO: 36227 - DNA, 16 bp, Artificial Sequence
  synthetic [barcode part1]
gtgatcttgagtcacg

SEQ ID NO: 36228 - DNA, 16 bp, Artificial Sequence
  synthetic [barcode part1]
cctggacgttctctag

SEQ ID NO: 36229 - DNA, 16 bp, Artificial Sequence
  synthetic [barcode part1]
ttctatcctgcaagtg

SEQ ID NO: 36230 - DNA, 16 bp, Artificial Sequence
  synthetic [barcode part1]
gtagtgccttcgaagt

SEQ ID NO: 36231 - DNA, 16 bp, Artificial Sequence
  synthetic [barcode part1]
atcgcggtactacaac

SEQ ID NO: 36232 - DNA, 16 bp, Artificial Sequence
  synthetic [barcode part1]
accagttcacgtacag

SEQ ID NO: 36233 - DNA, 16 bp, Artificial Sequence
  synthetic [barcode part1]
caactgtatccgaacg

SEQ ID NO: 36234 - DNA, 16 bp, Artificial Sequence
  synthetic [barcode part1]
ttacttcggaacgacg

SEQ ID NO: 36235 - DNA, 16 bp, Artificial Sequence
  synthetic [barcode part1]
attccaggtcgtaacg

SEQ ID NO: 36236 - DNA, 16 bp, Artificial Sequence
  synthetic [barcode part1]
tactggtgtgtaccag

SEQ ID NO: 36237 - DNA, 16 bp, Artificial Sequence
  synthetic [barcode part1]
ttcacgacaccgtctg

SEQ ID NO: 36238 - DNA, 16 bp, Artificial Sequence
  synthetic [barcode part1]
gcctgtgtatatcgag

SEQ ID NO: 36239 - DNA, 16 bp, Artificial Sequence
  synthetic [barcode part1]
ccttggcaatcgcgtt

SEQ ID NO: 36240 - DNA, 16 bp, Artificial Sequence
  synthetic [barcode part1]
agtgtactcaggaggc

SEQ ID NO: 36241 - DNA, 16 bp, Artificial Sequence
  synthetic [barcode part1]
gccactctagatactt

SEQ ID NO: 36242 - DNA, 16 bp, Artificial Sequence
  synthetic [barcode part1]
ttccgtgaatcaccgc

SEQ ID NO: 36243 - DNA, 16 bp, Artificial Sequence
  synthetic [barcode part1]
ttaagaccgtctgtct

SEQ ID NO: 36244 - DNA, 16 bp, Artificial Sequence
  synthetic [barcode part1]
gatcgacaccgtaact

SEQ ID NO: 36245 - DNA, 16 bp, Artificial Sequence
  synthetic [barcode part1]
aacgtcagttgcagtc

SEQ ID NO: 36246 - DNA, 16 bp, Artificial Sequence
  synthetic [barcode part1]
agttcaggatcgttgc

SEQ ID NO: 36247 - DNA, 16 bp, Artificial Sequence
  synthetic [barcode part1]
cgactagatcgcaact

SEQ ID NO: 36248 - DNA, 16 bp, Artificial Sequence
  synthetic [barcode part1]
agtaatctctccacgt

SEQ ID NO: 36249 - DNA, 16 bp, Artificial Sequence
  synthetic [barcode part1]
tcctaactcctcgact

SEQ ID NO: 36250 - DNA, 16 bp, Artificial Sequence
  synthetic [barcode part1]
tctcttcctggtcaac

SEQ ID NO: 36251 - DNA, 16 bp, Artificial Sequence
  synthetic [barcode part1]
tagtaaggtctcgtcg

SEQ ID NO: 36252 - DNA, 16 bp, Artificial Sequence
  synthetic [barcode part1]
cgagtatcacgaactc

SEQ ID NO: 36253 - DNA, 16 bp, Artificial Sequence
  synthetic [barcode part1]
tctagacgtagtcacg

SEQ ID NO: 36254 - DNA, 16 bp, Artificial Sequence
  synthetic [barcode part1]
cgtagtaacctcgaac

SEQ ID NO: 36255 - DNA, 16 bp, Artificial Sequence
  synthetic [barcode part1]
tcctcactctgataag

SEQ ID NO: 36256 - DNA, 16 bp, Artificial Sequence
  synthetic [barcode part1]
atcaacggtgagacgc

SEQ ID NO: 36257 - DNA, 16 bp, Artificial Sequence
  synthetic [barcode part1]
cagaattggcctcagt

SEQ ID NO: 36258 - DNA, 16 bp, Artificial Sequence
  synthetic [barcode part1]
ttgacacgatcctccg

SEQ ID NO: 36259 - DNA, 16 bp, Artificial Sequence
  synthetic [barcode part1]
taacagtggagacact

SEQ ID NO: 36260 - DNA, 16 bp, Artificial Sequence
  synthetic [barcode part1]
tgccgaggtaaggatc

SEQ ID NO: 36261 - DNA, 16 bp, Artificial Sequence
  synthetic [barcode part1]
agtgatcctccacgtc

SEQ ID NO: 36262 - DNA, 16 bp, Artificial Sequence
  synthetic [barcode part1]
agacagactgcggtgt

SEQ ID NO: 36263 - DNA, 16 bp, Artificial Sequence
  synthetic [barcode part1]
aagagttcgactgtag

SEQ ID NO: 36264 - DNA, 16 bp, Artificial Sequence
  synthetic [barcode part1]
tgtcagtacgtcagtg

SEQ ID NO: 36265 - DNA, 16 bp, Artificial Sequence
  synthetic [barcode part1]
gtagtaagtaaccgtg

SEQ ID NO: 36266 - DNA, 16 bp, Artificial Sequence
  synthetic [barcode part1]
gatctctaaggcgact

SEQ ID NO: 36267 - DNA, 16 bp, Artificial Sequence
  synthetic [barcode part1]
cgtgatactgtctatc

SEQ ID NO: 36268 - DNA, 16 bp, Artificial Sequence
  synthetic [barcode part1]
taatccggccttcacg

SEQ ID NO: 36269 - DNA, 16 bp, Artificial Sequence
  synthetic [barcode part1]
gtccgcactctactag

SEQ ID NO: 36270 - DNA, 16 bp, Artificial Sequence
  synthetic [barcode part1]
gcgttctgtacagaac

SEQ ID NO: 36271 - DNA, 16 bp, Artificial Sequence
  synthetic [barcode part1]
acggagaccagatcac

SEQ ID NO: 36272 - DNA, 16 bp, Artificial Sequence
  synthetic [barcode part1]
tcctggtgtgtccaac

SEQ ID NO: 36273 - DNA, 16 bp, Artificial Sequence
  synthetic [barcode part1]
gcaagtcaagaactgt

SEQ ID NO: 36274 - DNA, 16 bp, Artificial Sequence
  synthetic [barcode part1]
actcgtcaggtagatc

SEQ ID NO: 36275 - DNA, 16 bp, Artificial Sequence
  synthetic [barcode part1]
cctaatcaggagacct

SEQ ID NO: 36276 - DNA, 16 bp, Artificial Sequence
  synthetic [barcode part1]
tggtctcgtatatcac

SEQ ID NO: 36277 - DNA, 16 bp, Artificial Sequence
  synthetic [barcode part1]
cgttattgcagaacgc

SEQ ID NO: 36278 - DNA, 16 bp, Artificial Sequence
  synthetic [barcode part1]
tccgatcgtgtgttgc

SEQ ID NO: 36279 - DNA, 16 bp, Artificial Sequence
  synthetic [barcode part1]
agtgcgtaggaggtct

SEQ ID NO: 36280 - DNA, 16 bp, Artificial Sequence
  synthetic [barcode part1]
cgtatcttgccggact

SEQ ID NO: 36281 - DNA, 16 bp, Artificial Sequence
  synthetic [barcode part1]
atctcactgaatccgt

SEQ ID NO: 36282 - DNA, 16 bp, Artificial Sequence
  synthetic [barcode part1]
aacgttgcaacaccac

SEQ ID NO: 36283 - DNA, 16 bp, Artificial Sequence
  synthetic [barcode part1]
ccttccactgttgttg

SEQ ID NO: 36284 - DNA, 16 bp, Artificial Sequence
  synthetic [barcode part1]
tacagacttgttctgc

SEQ ID NO: 36285 - DNA, 16 bp, Artificial Sequence
  synthetic [barcode part1]
gtcacttacagactct

SEQ ID NO: 36286 - DNA, 16 bp, Artificial Sequence
  synthetic [barcode part1]
tcaaccacagtaccag

SEQ ID NO: 36287 - DNA, 16 bp, Artificial Sequence
  synthetic [barcode part1]
aatccggtgtggaggt

SEQ ID NO: 36288 - DNA, 16 bp, Artificial Sequence
  synthetic [barcode part1]
tatcgcaggtctcaag

SEQ ID NO: 36289 - DNA, 16 bp, Artificial Sequence
  synthetic [barcode part1]
tcaatctacttggacc

SEQ ID NO: 36290 - DNA, 16 bp, Artificial Sequence
  synthetic [barcode part1]
cctcgttaacagagtg

SEQ ID NO: 36291 - DNA, 16 bp, Artificial Sequence
  synthetic [barcode part1]
tgacagtgatcaccac

SEQ ID NO: 36292 - DNA, 16 bp, Artificial Sequence
  synthetic [barcode part1]
aggactgactgaagag

SEQ ID NO: 36293 - DNA, 16 bp, Artificial Sequence
  synthetic [barcode part1]
gaatcctactacggtg

SEQ ID NO: 36294 - DNA, 16 bp, Artificial Sequence
  synthetic [barcode part1]
cgtcgtccttaactct

SEQ ID NO: 36295 - DNA, 16 bp, Artificial Sequence
  synthetic [barcode part1]
gtaccttaatcgtcgt

SEQ ID NO: 36296 - DNA, 16 bp, Artificial Sequence
  synthetic [barcode part1]
gtattctcgatctgac

SEQ ID NO: 36297 - DNA, 16 bp, Artificial Sequence
  synthetic [barcode part1]
cggcaaccgtaagaac

SEQ ID NO: 36298 - DNA, 16 bp, Artificial Sequence
  synthetic [barcode part1]
gaggagttggagaatc

SEQ ID NO: 36299 - DNA, 16 bp, Artificial Sequence
  synthetic [barcode part1]
agagaactgttgacgt

SEQ ID NO: 36300 - DNA, 16 bp, Artificial Sequence
  synthetic [barcode part1]
ccgattaacgtgtgtg

SEQ ID NO: 36301 - DNA, 16 bp, Artificial Sequence
  synthetic [barcode part1]
tccgagacttccttct

SEQ ID NO: 36302 - DNA, 16 bp, Artificial Sequence
  synthetic [barcode part1]
gtgcggttctcagttc

SEQ ID NO: 36303 - DNA, 16 bp, Artificial Sequence
  synthetic [barcode part1]
ccgcaagacttaagtc

SEQ ID NO: 36304 - DNA, 16 bp, Artificial Sequence
  synthetic [barcode part1]
tagacgtcgtaggttc

SEQ ID NO: 36305 - DNA, 16 bp, Artificial Sequence
  synthetic [barcode part1]
gagtatcctgcgaatc

SEQ ID NO: 36306 - DNA, 16 bp, Artificial Sequence
  synthetic [barcode part1]
tggtctcctaaggaac

SEQ ID NO: 36307 - DNA, 16 bp, Artificial Sequence
  synthetic [barcode part1]
gttgactactgaccag

SEQ ID NO: 36308 - DNA, 16 bp, Artificial Sequence
  synthetic [barcode part1]
caggtcaagtcactgt

SEQ ID NO: 36309 - DNA, 16 bp, Artificial Sequence
  synthetic [barcode part1]
attctgtacggttacc

SEQ ID NO: 36310 - DNA, 16 bp, Artificial Sequence
  synthetic [barcode part1]
tcactccacacgactg

SEQ ID NO: 36311 - DNA, 16 bp, Artificial Sequence
  synthetic [barcode part1]
acagtgcagagttcct

SEQ ID NO: 36312 - DNA, 16 bp, Artificial Sequence
  synthetic [barcode part1]
gttcacctcgcaacac

SEQ ID NO: 36313 - DNA, 16 bp, Artificial Sequence
  synthetic [barcode part1]
aaggtgaacttgcagt

SEQ ID NO: 36314 - DNA, 16 bp, Artificial Sequence
  synthetic [barcode part1]
ttcactacgactcctc

SEQ ID NO: 36315 - DNA, 16 bp, Artificial Sequence
  synthetic [barcode part1]
gacgagatagtctctc

SEQ ID NO: 36316 - DNA, 16 bp, Artificial Sequence
  synthetic [barcode part1]
cggaattgaggtcttc

SEQ ID NO: 36317 - DNA, 16 bp, Artificial Sequence
  synthetic [barcode part1]
cgatactgacactacg

SEQ ID NO: 36318 - DNA, 16 bp, Artificial Sequence
  synthetic [barcode part1]
tggagactgagaacag

SEQ ID NO: 36319 - DNA, 16 bp, Artificial Sequence
  synthetic [barcode part1]
taaccacggatactcg

SEQ ID NO: 36320 - DNA, 16 bp, Artificial Sequence
  synthetic [barcode part1]
gagttacacagttcgc

SEQ ID NO: 36321 - DNA, 16 bp, Artificial Sequence
  synthetic [barcode part1]
atcgtggacggtactt

SEQ ID NO: 36322 - DNA, 16 bp, Artificial Sequence
  synthetic [barcode part1]
ttccagaacgacactg

SEQ ID NO: 36323 - DNA, 16 bp, Artificial Sequence
  synthetic [barcode part1]
attgaccggtcaatcg

SEQ ID NO: 36324 - DNA, 16 bp, Artificial Sequence
  synthetic [barcode part1]
gtcctcgcaccgaatt

SEQ ID NO: 36325 - DNA, 16 bp, Artificial Sequence
  synthetic [barcode part1]
tagacgtgatctgcac

SEQ ID NO: 36326 - DNA, 16 bp, Artificial Sequence
  synthetic [barcode part1]
gtgactatcggtcctc

SEQ ID NO: 36327 - DNA, 16 bp, Artificial Sequence
  synthetic [barcode part1]
cgttcacttgcggtac

SEQ ID NO: 36328 - DNA, 16 bp, Artificial Sequence
  synthetic [barcode part1]
actgaggatcgtgcag

SEQ ID NO: 36329 - DNA, 16 bp, Artificial Sequence
  synthetic [barcode part1]
cctcgtattggaccac

SEQ ID NO: 36330 - DNA, 16 bp, Artificial Sequence
  synthetic [barcode part1]
aggcgattgtggatcg

SEQ ID NO: 36331 - DNA, 16 bp, Artificial Sequence
  synthetic [barcode part1]
gtggactcctctaatt

SEQ ID NO: 36332 - DNA, 16 bp, Artificial Sequence
  synthetic [barcode part1]
gttgttgatatctccg

SEQ ID NO: 36333 - DNA, 16 bp, Artificial Sequence
  synthetic [barcode part1]
ttataccggtgcagac

SEQ ID NO: 36334 - DNA, 16 bp, Artificial Sequence
  synthetic [barcode part1]
cctggtgttcgtactg

SEQ ID NO: 36335 - DNA, 16 bp, Artificial Sequence
  synthetic [barcode part1]
ttatcggttcctgtag

SEQ ID NO: 36336 - DNA, 16 bp, Artificial Sequence
  synthetic [barcode part1]
tcgaacggcggtaagt

SEQ ID NO: 36337 - DNA, 16 bp, Artificial Sequence
  synthetic [barcode part1]
tgtcgagtctgtactt

SEQ ID NO: 36338 - DNA, 16 bp, Artificial Sequence
  synthetic [barcode part1]
tgtgaatctcaggcgt

SEQ ID NO: 36339 - DNA, 16 bp, Artificial Sequence
  synthetic [barcode part1]
attggacggcaattcc

SEQ ID NO: 36340 - DNA, 16 bp, Artificial Sequence
  synthetic [barcode part1]
ttataacaccgcggtg

SEQ ID NO: 36341 - DNA, 16 bp, Artificial Sequence
  synthetic [barcode part1]
atattcctctccacgc

SEQ ID NO: 36342 - DNA, 16 bp, Artificial Sequence
  synthetic [barcode part1]
acttgttcacctgtcc

SEQ ID NO: 36343 - DNA, 16 bp, Artificial Sequence
  synthetic [barcode part1]
aggattatcgacgtag

SEQ ID NO: 36344 - DNA, 16 bp, Artificial Sequence
  synthetic [barcode part1]
cagaaggatcacgtgc

SEQ ID NO: 36345 - DNA, 16 bp, Artificial Sequence
  synthetic [barcode part1]
gcagtccgaacacaag

SEQ ID NO: 36346 - DNA, 16 bp, Artificial Sequence
  synthetic [barcode part1]
ccgtcttctaggtacg

SEQ ID NO: 36347 - DNA, 16 bp, Artificial Sequence
  synthetic [barcode part1]
tctgtgcgattcaatc

SEQ ID NO: 36348 - DNA, 16 bp, Artificial Sequence
  synthetic [barcode part1]
aaggacgtcgtacttc

SEQ ID NO: 36349 - DNA, 16 bp, Artificial Sequence
  synthetic [barcode part1]
ccttcgaacgtcagtc

SEQ ID NO: 36350 - DNA, 16 bp, Artificial Sequence
  synthetic [barcode part1]
ataccagaggatagtc

SEQ ID NO: 36351 - DNA, 16 bp, Artificial Sequence
  synthetic [barcode part1]
caaccaggaagaaggt

SEQ ID NO: 36352 - DNA, 16 bp, Artificial Sequence
  synthetic [barcode part1]
tacgtactgtggtacg

SEQ ID NO: 36353 - DNA, 16 bp, Artificial Sequence
  synthetic [barcode part1]
gagatcgtcgagtgtg

SEQ ID NO: 36354 - DNA, 16 bp, Artificial Sequence
  synthetic [barcode part1]
tccacgtaattatcgc

SEQ ID NO: 36355 - DNA, 16 bp, Artificial Sequence
  synthetic [barcode part1]
tccgtcggttatcctt

SEQ ID NO: 36356 - DNA, 16 bp, Artificial Sequence
  synthetic [barcode part1]
caccgaggtaattcac

SEQ ID NO: 36357 - DNA, 16 bp, Artificial Sequence
  synthetic [barcode part1]
aagtacctctgtcgcc

SEQ ID NO: 36358 - DNA, 16 bp, Artificial Sequence
  synthetic [barcode part1]
gtgtctctgtatcctc

SEQ ID NO: 36359 - DNA, 16 bp, Artificial Sequence
  synthetic [barcode part1]
acgttgaaggaattgc

SEQ ID NO: 36360 - DNA, 16 bp, Artificial Sequence
  synthetic [barcode part1]
atcacttcgtctagac

SEQ ID NO: 36361 - DNA, 16 bp, Artificial Sequence
  synthetic [barcode part1]
ttgtggttgactgacg

SEQ ID NO: 36362 - DNA, 16 bp, Artificial Sequence
  synthetic [barcode part1]
tagtaaccgtgtctct

SEQ ID NO: 36363 - DNA, 16 bp, Artificial Sequence
  synthetic [barcode part1]
atctactctgcaacac

SEQ ID NO: 36364 - DNA, 16 bp, Artificial Sequence
  synthetic [barcode part1]
gttggcctaattggtg

SEQ ID NO: 36365 - DNA, 16 bp, Artificial Sequence
  synthetic [barcode part1]
aacgttctagagagtg

SEQ ID NO: 36366 - DNA, 16 bp, Artificial Sequence
  synthetic [barcode part1]
ttctctcgtcgtaacc

SEQ ID NO: 36367 - DNA, 16 bp, Artificial Sequence
  synthetic [barcode part1]
gactgagaatataccg

SEQ ID NO: 36368 - DNA, 16 bp, Artificial Sequence
  synthetic [barcode part1]
gcaggccggagtaatt

SEQ ID NO: 36369 - DNA, 16 bp, Artificial Sequence
  synthetic [barcode part1]
cacacctgttcaacgc

SEQ ID NO: 36370 - DNA, 16 bp, Artificial Sequence
  synthetic [barcode part1]
gttggttccaagatcg

SEQ ID NO: 36371 - DNA, 16 bp, Artificial Sequence
  synthetic [barcode part1]
caggcgtctcttagtc

SEQ ID NO: 36372 - DNA, 16 bp, Artificial Sequence
  synthetic [barcode part1]
ccaagtacctaagtgc

SEQ ID NO: 36373 - DNA, 16 bp, Artificial Sequence
  synthetic [barcode part1]
gcgtcggttgagtatt

SEQ ID NO: 36374 - DNA, 16 bp, Artificial Sequence
  synthetic [barcode part1]
aatagagtggcggaac

SEQ ID NO: 36375 - DNA, 16 bp, Artificial Sequence
  synthetic [barcode part1]
tacttatctgtggcgt

SEQ ID NO: 36376 - DNA, 16 bp, Artificial Sequence
  synthetic [barcode part1]
taagttgcacactcct

SEQ ID NO: 36377 - DNA, 16 bp, Artificial Sequence
  synthetic [barcode part1]
aagtgaatcgtgacac

SEQ ID NO: 36378 - DNA, 16 bp, Artificial Sequence
  synthetic [barcode part1]
agattccggaactctg

SEQ ID NO: 36379 - DNA, 16 bp, Artificial Sequence
  synthetic [barcode part1]
gttgcaaggcgagtac

SEQ ID NO: 36380 - DNA, 16 bp, Artificial Sequence
  synthetic [barcode part1]
ccgtaggataaggtgc

SEQ ID NO: 36381 - DNA, 16 bp, Artificial Sequence
  synthetic [barcode part1]
ttaccgatacagagag

SEQ ID NO: 36382 - DNA, 16 bp, Artificial Sequence
  synthetic [barcode part1]
tcagaacttacggtgc

SEQ ID NO: 36383 - DNA, 16 bp, Artificial Sequence
  synthetic [barcode part1]
tggagtccgatcagtt

SEQ ID NO: 36384 - DNA, 16 bp, Artificial Sequence
  synthetic [barcode part1]
gtgtggcaatccttcc

SEQ ID NO: 36385 - DNA, 16 bp, Artificial Sequence
  synthetic [barcode part1]
tacaggcgataaggtt

SEQ ID NO: 36386 - DNA, 16 bp, Artificial Sequence
  synthetic [barcode part1]
acgtcggatcacttcc

SEQ ID NO: 36387 - DNA, 16 bp, Artificial Sequence
  synthetic [barcode part1]
ataacagtccgtgaag

SEQ ID NO: 36388 - DNA, 16 bp, Artificial Sequence
  synthetic [barcode part1]
caccttaattcacggt

SEQ ID NO: 36389 - DNA, 16 bp, Artificial Sequence
  synthetic [barcode part1]
gttctagatcgaccag

SEQ ID NO: 36390 - DNA, 16 bp, Artificial Sequence
  synthetic [barcode part1]
taaccaccttaacctg

SEQ ID NO: 36391 - DNA, 16 bp, Artificial Sequence
  synthetic [barcode part1]
tcacaagtgttccgcc

SEQ ID NO: 36392 - DNA, 16 bp, Artificial Sequence
  synthetic [barcode part1]
tagaccggtattctct

SEQ ID NO: 36393 - DNA, 16 bp, Artificial Sequence
  synthetic [barcode part1]
cacctatacttcgagt

SEQ ID NO: 36394 - DNA, 16 bp, Artificial Sequence
  synthetic [barcode part1]
tgcacttgtcctcgtt

SEQ ID NO: 36395 - DNA, 16 bp, Artificial Sequence
  synthetic [barcode part1]
gtgatcactggccttc

SEQ ID NO: 36396 - DNA, 16 bp, Artificial Sequence
  synthetic [barcode part1]
gcggtcagactagaac

SEQ ID NO: 36397 - DNA, 16 bp, Artificial Sequence
  synthetic [barcode part1]
caacgttggacgagtg

SEQ ID NO: 36398 - DNA, 16 bp, Artificial Sequence
  synthetic [barcode part1]
attacctgcagtaggc

SEQ ID NO: 36399 - DNA, 16 bp, Artificial Sequence
  synthetic [barcode part1]
tgtaccttaccaggtt

SEQ ID NO: 36400 - DNA, 16 bp, Artificial Sequence
  synthetic [barcode part1]
tcttgcgtcggatcac

SEQ ID NO: 36401 - DNA, 16 bp, Artificial Sequence
  synthetic [barcode part1]
cgtctcagaataacgc

SEQ ID NO: 36402 - DNA, 16 bp, Artificial Sequence
  synthetic [barcode part1]
tggtactcctgcctag

SEQ ID NO: 36403 - DNA, 16 bp, Artificial Sequence
  synthetic [barcode part1]
actaagaacgtcaacg

SEQ ID NO: 36404 - DNA, 16 bp, Artificial Sequence
  synthetic [barcode part1]
gtcactcgataagacc

SEQ ID NO: 36405 - DNA, 16 bp, Artificial Sequence
  synthetic [barcode part1]
ccgattctgccagtac

SEQ ID NO: 36406 - DNA, 16 bp, Artificial Sequence
  synthetic [barcode part1]
ttgaccaactgcagtg

SEQ ID NO: 36407 - DNA, 16 bp, Artificial Sequence
  synthetic [barcode part1]
cgttagtcacggttag

SEQ ID NO: 36408 - DNA, 16 bp, Artificial Sequence
  synthetic [barcode part1]
gttggtagtagtcgtc

SEQ ID NO: 36409 - DNA, 16 bp, Artificial Sequence
  synthetic [barcode part1]
tcctggttacgtcgac

SEQ ID NO: 36410 - DNA, 16 bp, Artificial Sequence
  synthetic [barcode part1]
tccactactctgtcgt

SEQ ID NO: 36411 - DNA, 16 bp, Artificial Sequence
  synthetic [barcode part1]
tcaccaatacgcctcg

SEQ ID NO: 36412 - DNA, 16 bp, Artificial Sequence
  synthetic [barcode part1]
tcgagtatccaccgtc

SEQ ID NO: 36413 - DNA, 16 bp, Artificial Sequence
  synthetic [barcode part1]
cgtgaataccttatcc

SEQ ID NO: 36414 - DNA, 16 bp, Artificial Sequence
  synthetic [barcode part1]
acctaccgataccacc

SEQ ID NO: 36415 - DNA, 16 bp, Artificial Sequence
  synthetic [barcode part1]
cgacgtgagaggttac

SEQ ID NO: 36416 - DNA, 16 bp, Artificial Sequence
  synthetic [barcode part1]
gtcaggtgtagaagtt

SEQ ID NO: 36417 - DNA, 16 bp, Artificial Sequence
  synthetic [barcode part1]
actcgaactattccac

SEQ ID NO: 36418 - DNA, 16 bp, Artificial Sequence
  synthetic [barcode part1]
ttgttggtggtaaccg

SEQ ID NO: 36419 - DNA, 16 bp, Artificial Sequence
  synthetic [barcode part1]
gtggacctccttagtc

SEQ ID NO: 36420 - DNA, 16 bp, Artificial Sequence
  synthetic [barcode part1]
tatccgcgaatctcgc

SEQ ID NO: 36421 - DNA, 16 bp, Artificial Sequence
  synthetic [barcode part1]
tgcacagaggtatcct

SEQ ID NO: 36422 - DNA, 16 bp, Artificial Sequence
  synthetic [barcode part1]
tcacaagataaggtgc

SEQ ID NO: 36423 - DNA, 16 bp, Artificial Sequence
  synthetic [barcode part1]
tacaacgtatcgtggc

SEQ ID NO: 36424 - DNA, 16 bp, Artificial Sequence
  synthetic [barcode part1]
tcggtatactagtgcg

SEQ ID NO: 36425 - DNA, 16 bp, Artificial Sequence
  synthetic [barcode part1]
ttacgtcgagttgtct

SEQ ID NO: 36426 - DNA, 16 bp, Artificial Sequence
  synthetic [barcode part1]
ccagagttccgagatt

SEQ ID NO: 36427 - DNA, 16 bp, Artificial Sequence
  synthetic [barcode part1]
atcgcggaataggtgc

SEQ ID NO: 36428 - DNA, 16 bp, Artificial Sequence
  synthetic [barcode part1]
acgaggagacctagtc

SEQ ID NO: 36429 - DNA, 16 bp, Artificial Sequence
  synthetic [barcode part1]
accacaactcacctgc

SEQ ID NO: 36430 - DNA, 16 bp, Artificial Sequence
  synthetic [barcode part1]
actggtacagaaggcc

SEQ ID NO: 36431 - DNA, 16 bp, Artificial Sequence
  synthetic [barcode part1]
tggaaggcgactgtac

SEQ ID NO: 36432 - DNA, 16 bp, Artificial Sequence
  synthetic [barcode part1]
taggactggttagtcc

SEQ ID NO: 36433 - DNA, 16 bp, Artificial Sequence
  synthetic [barcode part1]
agtgatctcaggttgc

SEQ ID NO: 36434 - DNA, 16 bp, Artificial Sequence
  synthetic [barcode part1]
aagtactccgttctgt

SEQ ID NO: 36435 - DNA, 16 bp, Artificial Sequence
  synthetic [barcode part1]
cgcgcgattattactt

SEQ ID NO: 36436 - DNA, 16 bp, Artificial Sequence
  synthetic [barcode part1]
cgagtgaggtactgtg

SEQ ID NO: 36437 - DNA, 16 bp, Artificial Sequence
  synthetic [barcode part1]
gcgagaagtcagactc

SEQ ID NO: 36438 - DNA, 16 bp, Artificial Sequence
  synthetic [barcode part1]
aatcgaaccgttgtcg

SEQ ID NO: 36439 - DNA, 16 bp, Artificial Sequence
  synthetic [barcode part1]
tgtgtgtagtcaaccg

SEQ ID NO: 36440 - DNA, 16 bp, Artificial Sequence
  synthetic [barcode part1]
gaattgcaacacgaac

SEQ ID NO: 36441 - DNA, 16 bp, Artificial Sequence
  synthetic [barcode part1]
gaatctggatacgtcc

SEQ ID NO: 36442 - DNA, 16 bp, Artificial Sequence
  synthetic [barcode part1]
acgtaggtatcctcag

SEQ ID NO: 36443 - DNA, 16 bp, Artificial Sequence
  synthetic [barcode part1]
atcgtcaacgtaagag

SEQ ID NO: 36444 - DNA, 16 bp, Artificial Sequence
  synthetic [barcode part1]
aacgttcctcagtccg

SEQ ID NO: 36445 - DNA, 16 bp, Artificial Sequence
  synthetic [barcode part1]
tactgaacttgcacct

SEQ ID NO: 36446 - DNA, 16 bp, Artificial Sequence
  synthetic [barcode part1]
tagtggtcctccacac

SEQ ID NO: 36447 - DNA, 16 bp, Artificial Sequence
  synthetic [barcode part1]
acggacaagtgagtag

SEQ ID NO: 36448 - DNA, 16 bp, Artificial Sequence
  synthetic [barcode part1]
ttccaagacttactcg

SEQ ID NO: 36449 - DNA, 16 bp, Artificial Sequence
  synthetic [barcode part1]
gaactgttctgacgac

SEQ ID NO: 36450 - DNA, 16 bp, Artificial Sequence
  synthetic [barcode part1]
tggcaccttactcacg

SEQ ID NO: 36451 - DNA, 16 bp, Artificial Sequence
  synthetic [barcode part1]
gacgtgtaaccgaggt

SEQ ID NO: 36452 - DNA, 16 bp, Artificial Sequence
  synthetic [barcode part1]
gtccgcaagagtagtg

SEQ ID NO: 36453 - DNA, 16 bp, Artificial Sequence
  synthetic [barcode part1]
agttcttccaagtacc

SEQ ID NO: 36454 - DNA, 16 bp, Artificial Sequence
  synthetic [barcode part1]
acgaccggattcttcc

SEQ ID NO: 36455 - DNA, 16 bp, Artificial Sequence
  synthetic [barcode part1]
gtaggccactgaagac

SEQ ID NO: 36456 - DNA, 16 bp, Artificial Sequence
  synthetic [barcode part1]
tcagactctgacagtg

SEQ ID NO: 36457 - DNA, 16 bp, Artificial Sequence
  synthetic [barcode part1]
tgagtacagtcacacc

SEQ ID NO: 36458 - DNA, 16 bp, Artificial Sequence
  synthetic [barcode part1]
ttacaggcgttggtac

SEQ ID NO: 36459 - DNA, 16 bp, Artificial Sequence
  synthetic [barcode part1]
ttgccaactccacacg

SEQ ID NO: 36460 - DNA, 16 bp, Artificial Sequence
  synthetic [barcode part1]
cctcgtaggttcgatc

SEQ ID NO: 36461 - DNA, 16 bp, Artificial Sequence
  synthetic [barcode part1]
gagaatactcgacggc

SEQ ID NO: 36462 - DNA, 16 bp, Artificial Sequence
  synthetic [barcode part1]
ttgcagattcaacctc

SEQ ID NO: 36463 - DNA, 16 bp, Artificial Sequence
  synthetic [barcode part1]
attcacgtgatctctg

SEQ ID NO: 36464 - DNA, 16 bp, Artificial Sequence
  synthetic [barcode part1]
ttgcactcgttagact

SEQ ID NO: 36465 - DNA, 16 bp, Artificial Sequence
  synthetic [barcode part1]
gagttacgaacacggc

SEQ ID NO: 36466 - DNA, 16 bp, Artificial Sequence
  synthetic [barcode part1]
gtgtaggacttctgtg

SEQ ID NO: 36467 - DNA, 16 bp, Artificial Sequence
  synthetic [barcode part1]
ttcacgactcgagtag

SEQ ID NO: 36468 - DNA, 16 bp, Artificial Sequence
  synthetic [barcode part1]
tcgaagtcgttgtgac

SEQ ID NO: 36469 - DNA, 16 bp, Artificial Sequence
  synthetic [barcode part1]
gatagatcaggacttg

SEQ ID NO: 36470 - DNA, 16 bp, Artificial Sequence
  synthetic [barcode part1]
tacgacaagaccttgc

SEQ ID NO: 36471 - DNA, 16 bp, Artificial Sequence
  synthetic [barcode part1]
acttctatcgccggac

SEQ ID NO: 36472 - DNA, 16 bp, Artificial Sequence
  synthetic [barcode part1]
tagttccgtatcggtt

SEQ ID NO: 36473 - DNA, 16 bp, Artificial Sequence
  synthetic [barcode part1]
tatcctatcacgagtc

SEQ ID NO: 36474 - DNA, 16 bp, Artificial Sequence
  synthetic [barcode part1]
taccaactggtacacg

SEQ ID NO: 36475 - DNA, 16 bp, Artificial Sequence
  synthetic [barcode part1]
cgaatcagttaccgac

SEQ ID NO: 36476 - DNA, 16 bp, Artificial Sequence
  synthetic [barcode part1]
acctactacgaacggt

SEQ ID NO: 36477 - DNA, 16 bp, Artificial Sequence
  synthetic [barcode part1]
gaatcgttgtctccgc

SEQ ID NO: 36478 - DNA, 16 bp, Artificial Sequence
  synthetic [barcode part1]
agtactcgacgtatcg

SEQ ID NO: 36479 - DNA, 16 bp, Artificial Sequence
  synthetic [barcode part1]
gtatacggacttcgac

SEQ ID NO: 36480 - DNA, 16 bp, Artificial Sequence
  synthetic [barcode part1]
tcctacgaaccaccac

SEQ ID NO: 36481 - DNA, 16 bp, Artificial Sequence
  synthetic [barcode part1]
tcttcctggtcctaac

SEQ ID NO: 36482 - DNA, 16 bp, Artificial Sequence
  synthetic [barcode part1]
tgtggatagtgcctac

SEQ ID NO: 36483 - DNA, 16 bp, Artificial Sequence
  synthetic [barcode part1]
ttcaatccgtgaccgc

SEQ ID NO: 36484 - DNA, 16 bp, Artificial Sequence
  synthetic [barcode part1]
cagttctcctcctagt

SEQ ID NO: 36485 - DNA, 16 bp, Artificial Sequence
  synthetic [barcode part1]
aggttcaggtagtggc

SEQ ID NO: 36486 - DNA, 16 bp, Artificial Sequence
  synthetic [barcode part1]
tgtcgatagtcttctg

SEQ ID NO: 36487 - DNA, 16 bp, Artificial Sequence
  synthetic [barcode part1]
tctggattggaaggcg

SEQ ID NO: 36488 - DNA, 16 bp, Artificial Sequence
  synthetic [barcode part1]
gatccgataacgacct

SEQ ID NO: 36489 - DNA, 16 bp, Artificial Sequence
  synthetic [barcode part1]
tgaggacgttcttgtg

SEQ ID NO: 36490 - DNA, 16 bp, Artificial Sequence
  synthetic [barcode part1]
caacctaacggttcag

SEQ ID NO: 36491 - DNA, 16 bp, Artificial Sequence
  synthetic [barcode part1]
atagtagattcaggcg

SEQ ID NO: 36492 - DNA, 16 bp, Artificial Sequence
  synthetic [barcode part1]
gatacgcagttcttct

SEQ ID NO: 36493 - DNA, 16 bp, Artificial Sequence
  synthetic [barcode part1]
cgaccgattgattgac

SEQ ID NO: 36494 - DNA, 16 bp, Artificial Sequence
  synthetic [barcode part1]
ttaacctcgttctgcc

SEQ ID NO: 36495 - DNA, 16 bp, Artificial Sequence
  synthetic [barcode part1]
cgtatctctgccaggt

SEQ ID NO: 36496 - DNA, 16 bp, Artificial Sequence
  synthetic [barcode part1]
gtaccaagtgtagtcc

SEQ ID NO: 36497 - DNA, 16 bp, Artificial Sequence
  synthetic [barcode part1]
gtggaagtagtaactc

SEQ ID NO: 36498 - DNA, 16 bp, Artificial Sequence
  synthetic [barcode part1]
tctggccacaccaact

SEQ ID NO: 36499 - DNA, 16 bp, Artificial Sequence
  synthetic [barcode part1]
tggcctcgtgttaatt

SEQ ID NO: 36500 - DNA, 16 bp, Artificial Sequence
  synthetic [barcode part1]
agtacactatacggcc

SEQ ID NO: 36501 - DNA, 16 bp, Artificial Sequence
  synthetic [barcode part1]
ataccgacttcaccgc

SEQ ID NO: 36502 - DNA, 16 bp, Artificial Sequence
  synthetic [barcode part1]
ttgcaggtgaatccgt

SEQ ID NO: 36503 - DNA, 16 bp, Artificial Sequence
  synthetic [barcode part1]
ttcgaacctgccactg

SEQ ID NO: 36504 - DNA, 16 bp, Artificial Sequence
  synthetic [barcode part1]
cagacagtgcctattg

SEQ ID NO: 36505 - DNA, 16 bp, Artificial Sequence
  synthetic [barcode part1]
cgtggataggtgacgt

SEQ ID NO: 36506 - DNA, 16 bp, Artificial Sequence
  synthetic [barcode part1]
attgttagaccgccag

SEQ ID NO: 36507 - DNA, 16 bp, Artificial Sequence
  synthetic [barcode part1]
gtatccacaggataag

SEQ ID NO: 36508 - DNA, 16 bp, Artificial Sequence
  synthetic [barcode part1]
acactcttagtccagt

SEQ ID NO: 36509 - DNA, 16 bp, Artificial Sequence
  synthetic [barcode part1]
ttgatcttggactcac

SEQ ID NO: 36510 - DNA, 16 bp, Artificial Sequence
  synthetic [barcode part1]
aaggtcttccagagtc

SEQ ID NO: 36511 - DNA, 16 bp, Artificial Sequence
  synthetic [barcode part1]
acaagaacgcgttctc

SEQ ID NO: 36512 - DNA, 16 bp, Artificial Sequence
  synthetic [barcode part1]
actcgagtccaagtgt

SEQ ID NO: 36513 - DNA, 16 bp, Artificial Sequence
  synthetic [barcode part1]
tggttgagtatacgcc

SEQ ID NO: 36514 - DNA, 16 bp, Artificial Sequence
  synthetic [barcode part1]
acgtcctccaggttac

SEQ ID NO: 36515 - DNA, 16 bp, Artificial Sequence
  synthetic [barcode part1]
tatcgaaccacgtctt

SEQ ID NO: 36516 - DNA, 16 bp, Artificial Sequence
  synthetic [barcode part1]
tcacctggtcctgaac

SEQ ID NO: 36517 - DNA, 16 bp, Artificial Sequence
  synthetic [barcode part1]
cgtctgtgtctacttc

SEQ ID NO: 36518 - DNA, 16 bp, Artificial Sequence
  synthetic [barcode part1]
acgattcagacgtaag

SEQ ID NO: 36519 - DNA, 16 bp, Artificial Sequence
  synthetic [barcode part1]
tgtctcgagtgttcgc

SEQ ID NO: 36520 - DNA, 16 bp, Artificial Sequence
  synthetic [barcode part1]
aattcgatacggaggt

SEQ ID NO: 36521 - DNA, 16 bp, Artificial Sequence
  synthetic [barcode part1]
attggcggcggttatt

SEQ ID NO: 36522 - DNA, 16 bp, Artificial Sequence
  synthetic [barcode part1]
ccggcagtattgagtt

SEQ ID NO: 36523 - DNA, 16 bp, Artificial Sequence
  synthetic [barcode part1]
cgaccgttatcctgtg

SEQ ID NO: 36524 - DNA, 16 bp, Artificial Sequence
  synthetic [barcode part1]
atcggtattcacaggc

SEQ ID NO: 36525 - DNA, 16 bp, Artificial Sequence
  synthetic [barcode part1]
cagtgactgacgactt

SEQ ID NO: 36526 - DNA, 16 bp, Artificial Sequence
  synthetic [barcode part1]
ttccgtcggattcgtg

SEQ ID NO: 36527 - DNA, 16 bp, Artificial Sequence
  synthetic [barcode part1]
tgttactggcgcactc

SEQ ID NO: 36528 - DNA, 16 bp, Artificial Sequence
  synthetic [barcode part1]
gtcaactcaatcgacg

SEQ ID NO: 36529 - DNA, 16 bp, Artificial Sequence
  synthetic [barcode part1]
taacggtgttactggc

SEQ ID NO: 36530 - DNA, 16 bp, Artificial Sequence
  synthetic [barcode part1]
cgttgaacttgtgttc

SEQ ID NO: 36531 - DNA, 16 bp, Artificial Sequence
  synthetic [barcode part1]
cctcgatcacagactc

SEQ ID NO: 36532 - DNA, 16 bp, Artificial Sequence
  synthetic [barcode part1]
ttcaacttggccgcac

SEQ ID NO: 36533 - DNA, 16 bp, Artificial Sequence
  synthetic [barcode part1]
tacggcaggcaagtgt

SEQ ID NO: 36534 - DNA, 16 bp, Artificial Sequence
  synthetic [barcode part1]
tgatcctgttacacgt

SEQ ID NO: 36535 - DNA, 16 bp, Artificial Sequence
  synthetic [barcode part1]
aatctcttgtaccgac

SEQ ID NO: 36536 - DNA, 16 bp, Artificial Sequence
  synthetic [barcode part1]
ttgcgttgtctagtgt

SEQ ID NO: 36537 - DNA, 16 bp, Artificial Sequence
  synthetic [barcode part1]
atacaacgcgccaact

SEQ ID NO: 36538 - DNA, 16 bp, Artificial Sequence
  synthetic [barcode part1]
ttaggcagtctgcaac

SEQ ID NO: 36539 - DNA, 16 bp, Artificial Sequence
  synthetic [barcode part1]
taggcactctccgact

SEQ ID NO: 36540 - DNA, 16 bp, Artificial Sequence
  synthetic [barcode part1]
tctgcgttgattcaac

SEQ ID NO: 36541 - DNA, 16 bp, Artificial Sequence
  synthetic [barcode part1]
attagtgacaggacgt

SEQ ID NO: 36542 - DNA, 16 bp, Artificial Sequence
  synthetic [barcode part1]
gttaggtcctgcactc

SEQ ID NO: 36543 - DNA, 16 bp, Artificial Sequence
  synthetic [barcode part1]
gacagaatcgagtgtt

SEQ ID NO: 36544 - DNA, 16 bp, Artificial Sequence
  synthetic [barcode part1]
acgcaagataacctag

SEQ ID NO: 36545 - DNA, 16 bp, Artificial Sequence
  synthetic [barcode part1]
taaccaagttggccgt

SEQ ID NO: 36546 - DNA, 16 bp, Artificial Sequence
  synthetic [barcode part1]
tgaacggccgcaatag

SEQ ID NO: 36547 - DNA, 16 bp, Artificial Sequence
  synthetic [barcode part1]
cgaggaacgtgattgc

SEQ ID NO: 36548 - DNA, 16 bp, Artificial Sequence
  synthetic [barcode part1]
atacggtcacgattgc

SEQ ID NO: 36549 - DNA, 16 bp, Artificial Sequence
  synthetic [barcode part1]
tcacggatccaatctt

SEQ ID NO: 36550 - DNA, 16 bp, Artificial Sequence
  synthetic [barcode part1]
gacttccgattcacgc

SEQ ID NO: 36551 - DNA, 16 bp, Artificial Sequence
  synthetic [barcode part1]
tgcagaccgtcgtctt

SEQ ID NO: 36552 - DNA, 16 bp, Artificial Sequence
  synthetic [barcode part1]
caatagatctgccgtg

SEQ ID NO: 36553 - DNA, 16 bp, Artificial Sequence
  synthetic [barcode part1]
ccggttcgtaaccact

SEQ ID NO: 36554 - DNA, 16 bp, Artificial Sequence
  synthetic [barcode part1]
tctctataacgcggag

SEQ ID NO: 36555 - DNA, 16 bp, Artificial Sequence
  synthetic [barcode part1]
aggcgattgcaagtcg

SEQ ID NO: 36556 - DNA, 16 bp, Artificial Sequence
  synthetic [barcode part1]
cctctgagtcagtgtc

SEQ ID NO: 36557 - DNA, 16 bp, Artificial Sequence
  synthetic [barcode part1]
aacgccaggaattcct

SEQ ID NO: 36558 - DNA, 16 bp, Artificial Sequence
  synthetic [barcode part1]
acgtacaggaatcctc

SEQ ID NO: 36559 - DNA, 16 bp, Artificial Sequence
  synthetic [barcode part1]
tgtcgtctcgcacaac

SEQ ID NO: 36560 - DNA, 16 bp, Artificial Sequence
  synthetic [barcode part1]
ccgatagtcaccaagt

SEQ ID NO: 36561 - DNA, 16 bp, Artificial Sequence
  synthetic [barcode part1]
cgactctattgtacac

SEQ ID NO: 36562 - DNA, 16 bp, Artificial Sequence
  synthetic [barcode part1]
tcgagttccttcgcag

SEQ ID NO: 36563 - DNA, 16 bp, Artificial Sequence
  synthetic [barcode part1]
tgaggtcaccgcaatt

SEQ ID NO: 36564 - DNA, 16 bp, Artificial Sequence
  synthetic [barcode part1]
tggtatacaacgaggt

SEQ ID NO: 36565 - DNA, 16 bp, Artificial Sequence
  synthetic [barcode part1]
tgccggacttgtgttc

SEQ ID NO: 36566 - DNA, 16 bp, Artificial Sequence
  synthetic [barcode part1]
aggacagaacgagatc

SEQ ID NO: 36567 - DNA, 16 bp, Artificial Sequence
  synthetic [barcode part1]
aaccactgcgaagacg

SEQ ID NO: 36568 - DNA, 16 bp, Artificial Sequence
  synthetic [barcode part1]
gtgttcctcggtaacc

SEQ ID NO: 36569 - DNA, 16 bp, Artificial Sequence
  synthetic [barcode part1]
aactagacgccaatag

SEQ ID NO: 36570 - DNA, 16 bp, Artificial Sequence
  synthetic [barcode part1]
tgacgtaatcgcctcc

SEQ ID NO: 36571 - DNA, 16 bp, Artificial Sequence
  synthetic [barcode part1]
tggtgtattccgtcgc

SEQ ID NO: 36572 - DNA, 16 bp, Artificial Sequence
  synthetic [barcode part1]
taggtcacctcgtgtc

SEQ ID NO: 36573 - DNA, 16 bp, Artificial Sequence
  synthetic [barcode part1]
ccgataatacttctgc

SEQ ID NO: 36574 - DNA, 16 bp, Artificial Sequence
  synthetic [barcode part1]
tctgtcgttccactac

SEQ ID NO: 36575 - DNA, 16 bp, Artificial Sequence
  synthetic [barcode part1]
agtgtcagtcagtcac

SEQ ID NO: 36576 - DNA, 16 bp, Artificial Sequence
  synthetic [barcode part1]
gttgtgtacacgactg

SEQ ID NO: 36577 - DNA, 16 bp, Artificial Sequence
  synthetic [barcode part1]
taatctcgcgtcaatc

SEQ ID NO: 36578 - DNA, 16 bp, Artificial Sequence
  synthetic [barcode part1]
tgcaagtggacggtac

SEQ ID NO: 36579 - DNA, 16 bp, Artificial Sequence
  synthetic [barcode part1]
cgcggacttcgttgtt

SEQ ID NO: 36580 - DNA, 16 bp, Artificial Sequence
  synthetic [barcode part1]
taccaccgcaactgtc

SEQ ID NO: 36581 - DNA, 16 bp, Artificial Sequence
  synthetic [barcode part1]
tgcgcacaatctcaag

SEQ ID NO: 36582 - DNA, 16 bp, Artificial Sequence
  synthetic [barcode part1]
gatctctccttgtcgt

SEQ ID NO: 36583 - DNA, 16 bp, Artificial Sequence
  synthetic [barcode part1]
ttaacgcaactgagag

SEQ ID NO: 36584 - DNA, 16 bp, Artificial Sequence
  synthetic [barcode part1]
gagattactaggtacg

SEQ ID NO: 36585 - DNA, 16 bp, Artificial Sequence
  synthetic [barcode part1]
ttccgtcggatctacg

SEQ ID NO: 36586 - DNA, 16 bp, Artificial Sequence
  synthetic [barcode part1]
tacgttgcaacacacg

SEQ ID NO: 36587 - DNA, 16 bp, Artificial Sequence
  synthetic [barcode part1]
tacttcttcagtgacg

SEQ ID NO: 36588 - DNA, 16 bp, Artificial Sequence
  synthetic [barcode part1]
ttcctggattgtgtac

SEQ ID NO: 36589 - DNA, 16 bp, Artificial Sequence
  synthetic [barcode part1]
ttcgcgtgattgccac

SEQ ID NO: 36590 - DNA, 16 bp, Artificial Sequence
  synthetic [barcode part1]
aagtccaacggttgtc

SEQ ID NO: 36591 - DNA, 16 bp, Artificial Sequence
  synthetic [barcode part1]
aattccggcaataccg

SEQ ID NO: 36592 - DNA, 16 bp, Artificial Sequence
  synthetic [barcode part1]
tgagtgcactatcctt

SEQ ID NO: 36593 - DNA, 16 bp, Artificial Sequence
  synthetic [barcode part1]
actggactcactgagt

SEQ ID NO: 36594 - DNA, 16 bp, Artificial Sequence
  synthetic [barcode part1]
tcgcaataccgactag

SEQ ID NO: 36595 - DNA, 16 bp, Artificial Sequence
  synthetic [barcode part1]
cgtgtgatatcggtgt

SEQ ID NO: 36596 - DNA, 16 bp, Artificial Sequence
  synthetic [barcode part1]
tgagtcagtacttctc

SEQ ID NO: 36597 - DNA, 16 bp, Artificial Sequence
  synthetic [barcode part1]
tacttgcgtggcgtct

SEQ ID NO: 36598 - DNA, 16 bp, Artificial Sequence
  synthetic [barcode part1]
gagtaggacttactcc

SEQ ID NO: 36599 - DNA, 16 bp, Artificial Sequence
  synthetic [barcode part1]
tacggatattccactc

SEQ ID NO: 36600 - DNA, 16 bp, Artificial Sequence
  synthetic [barcode part1]
aggacgtgactattag

SEQ ID NO: 36601 - DNA, 16 bp, Artificial Sequence
  synthetic [barcode part1]
attctaccttggcctc

SEQ ID NO: 36602 - DNA, 16 bp, Artificial Sequence
  synthetic [barcode part1]
tacacttccacactcc

SEQ ID NO: 36603 - DNA, 16 bp, Artificial Sequence
  synthetic [barcode part1]
gacacagtgttcctag

SEQ ID NO: 36604 - DNA, 16 bp, Artificial Sequence
  synthetic [barcode part1]
gagtaggacgaacaac

SEQ ID NO: 36605 - DNA, 16 bp, Artificial Sequence
  synthetic [barcode part1]
tcgattgtctctcctg

SEQ ID NO: 36606 - DNA, 16 bp, Artificial Sequence
  synthetic [barcode part1]
taagtcgtccttacac

SEQ ID NO: 36607 - DNA, 16 bp, Artificial Sequence
  synthetic [barcode part1]
agtactgacgttgcac

SEQ ID NO: 36608 - DNA, 16 bp, Artificial Sequence
  synthetic [barcode part1]
tattcacctacggcgc

SEQ ID NO: 36609 - DNA, 16 bp, Artificial Sequence
  synthetic [barcode part1]
gattgaatctgcgaag

SEQ ID NO: 36610 - DNA, 16 bp, Artificial Sequence
  synthetic [barcode part1]
aatcacacgcgtggtt

SEQ ID NO: 36611 - DNA, 16 bp, Artificial Sequence
  synthetic [barcode part1]
aagaacggtagtctgt

SEQ ID NO: 36612 - DNA, 16 bp, Artificial Sequence
  synthetic [barcode part1]
attaggagtgccgacg

SEQ ID NO: 36613 - DNA, 16 bp, Artificial Sequence
  synthetic [barcode part1]
taggatctcaggactc

SEQ ID NO: 36614 - DNA, 16 bp, Artificial Sequence
  synthetic [barcode part1]
gtccttaagtgcaggt

SEQ ID NO: 36615 - DNA, 16 bp, Artificial Sequence
  synthetic [barcode part1]
ttctcgacaacgtgtt

SEQ ID NO: 36616 - DNA, 16 bp, Artificial Sequence
  synthetic [barcode part1]
ttcgcggatcttgtcg

SEQ ID NO: 36617 - DNA, 16 bp, Artificial Sequence
  synthetic [barcode part1]
tctattggcgtagttc

SEQ ID NO: 36618 - DNA, 16 bp, Artificial Sequence
  synthetic [barcode part1]
accactctcacagacc

SEQ ID NO: 36619 - DNA, 16 bp, Artificial Sequence
  synthetic [barcode part1]
tagtgtctcgtgacag

SEQ ID NO: 36620 - DNA, 16 bp, Artificial Sequence
  synthetic [barcode part1]
atcgtggttatccgtt

SEQ ID NO: 36621 - DNA, 16 bp, Artificial Sequence
  synthetic [barcode part1]
caagaggacgtatcgc

SEQ ID NO: 36622 - DNA, 16 bp, Artificial Sequence
  synthetic [barcode part1]
cgactatctgcacaag

SEQ ID NO: 36623 - DNA, 16 bp, Artificial Sequence
  synthetic [barcode part1]
cgcaccaagtcttctg

SEQ ID NO: 36624 - DNA, 16 bp, Artificial Sequence
  synthetic [barcode part1]
atcggattactctcac

SEQ ID NO: 36625 - DNA, 16 bp, Artificial Sequence
  synthetic [barcode part1]
ttgaccaacaccacag

SEQ ID NO: 36626 - DNA, 16 bp, Artificial Sequence
  synthetic [barcode part1]
acggttattgatcctc

SEQ ID NO: 36627 - DNA, 16 bp, Artificial Sequence
  synthetic [barcode part1]
acgtctacctgtcacg

SEQ ID NO: 36628 - DNA, 16 bp, Artificial Sequence
  synthetic [barcode part1]
aggcagtggttacacg

SEQ ID NO: 36629 - DNA, 16 bp, Artificial Sequence
  synthetic [barcode part1]
agtcctatcgtctgcg

SEQ ID NO: 36630 - DNA, 16 bp, Artificial Sequence
  synthetic [barcode part1]
ttggaggaattacacg

SEQ ID NO: 36631 - DNA, 16 bp, Artificial Sequence
  synthetic [barcode part1]
ttctaacgtcgtctcc

SEQ ID NO: 36632 - DNA, 16 bp, Artificial Sequence
  synthetic [barcode part1]
tgtgacagacaggcac

SEQ ID NO: 36633 - DNA, 16 bp, Artificial Sequence
  synthetic [barcode part1]
ttagtggtaagtcgcc

SEQ ID NO: 36634 - DNA, 16 bp, Artificial Sequence
  synthetic [barcode part1]
cgtaggtagacggtgt

SEQ ID NO: 36635 - DNA, 16 bp, Artificial Sequence
  synthetic [barcode part1]
agactctaaggttccg

SEQ ID NO: 36636 - DNA, 16 bp, Artificial Sequence
  synthetic [barcode part1]
gcgactataacgcact

SEQ ID NO: 36637 - DNA, 16 bp, Artificial Sequence
  synthetic [barcode part1]
tcttcggagagttgac

SEQ ID NO: 36638 - DNA, 16 bp, Artificial Sequence
  synthetic [barcode part1]
tatattcgcggtctgt

SEQ ID NO: 36639 - DNA, 16 bp, Artificial Sequence
  synthetic [barcode part1]
ttgcagtagtcaaccg

SEQ ID NO: 36640 - DNA, 16 bp, Artificial Sequence
  synthetic [barcode part1]
tccgagacgcagtatt

SEQ ID NO: 36641 - DNA, 16 bp, Artificial Sequence
  synthetic [barcode part1]
tataggcaagtgacac

SEQ ID NO: 36642 - DNA, 16 bp, Artificial Sequence
  synthetic [barcode part1]
actaccaggttgtcag

SEQ ID NO: 36643 - DNA, 16 bp, Artificial Sequence
  synthetic [barcode part1]
cagaatatccgtgaag

SEQ ID NO: 36644 - DNA, 16 bp, Artificial Sequence
  synthetic [barcode part1]
gcaattcagtgcggag

SEQ ID NO: 36645 - DNA, 16 bp, Artificial Sequence
  synthetic [barcode part1]
cgttccacttgttgtc

SEQ ID NO: 36646 - DNA, 16 bp, Artificial Sequence
  synthetic [barcode part1]
acactacctacttacg

SEQ ID NO: 36647 - DNA, 16 bp, Artificial Sequence
  synthetic [barcode part1]
gtccacgtacactaag

SEQ ID NO: 36648 - DNA, 16 bp, Artificial Sequence
  synthetic [barcode part1]
tggcagaggatagtag

SEQ ID NO: 36649 - DNA, 16 bp, Artificial Sequence
  synthetic [barcode part1]
gacctggttgaattgc

SEQ ID NO: 36650 - DNA, 16 bp, Artificial Sequence
  synthetic [barcode part1]
ccacaccggatatagt

SEQ ID NO: 36651 - DNA, 16 bp, Artificial Sequence
  synthetic [barcode part1]
tctatcgtgcagactt

SEQ ID NO: 36652 - DNA, 16 bp, Artificial Sequence
  synthetic [barcode part1]
gtggttagagaagttc

SEQ ID NO: 36653 - DNA, 16 bp, Artificial Sequence
  synthetic [barcode part1]
gtacgttgaatcgaag

SEQ ID NO: 36654 - DNA, 16 bp, Artificial Sequence
  synthetic [barcode part1]
taggacgtagagaacg

SEQ ID NO: 36655 - DNA, 16 bp, Artificial Sequence
  synthetic [barcode part1]
ccgagtgatctgtaac

SEQ ID NO: 36656 - DNA, 16 bp, Artificial Sequence
  synthetic [barcode part1]
tctctcgtatcctacg

SEQ ID NO: 36657 - DNA, 16 bp, Artificial Sequence
  synthetic [barcode part1]
aaccgttccgcacttg

SEQ ID NO: 36658 - DNA, 16 bp, Artificial Sequence
  synthetic [barcode part1]
agtgccagagacttct

SEQ ID NO: 36659 - DNA, 16 bp, Artificial Sequence
  synthetic [barcode part1]
acgcgatccaactcct

SEQ ID NO: 36660 - DNA, 16 bp, Artificial Sequence
  synthetic [barcode part1]
agatctgactcagacc

SEQ ID NO: 36661 - DNA, 16 bp, Artificial Sequence
  synthetic [barcode part1]
aatccggttctacgtt

SEQ ID NO: 36662 - DNA, 16 bp, Artificial Sequence
  synthetic [barcode part1]
aagtctccggttagtg

SEQ ID NO: 36663 - DNA, 16 bp, Artificial Sequence
  synthetic [barcode part1]
agatccacgttctatc

SEQ ID NO: 36664 - DNA, 16 bp, Artificial Sequence
  synthetic [barcode part1]
gattggttacgtgtgc

SEQ ID NO: 36665 - DNA, 16 bp, Artificial Sequence
  synthetic [barcode part1]
tgacactctcaagacg

SEQ ID NO: 36666 - DNA, 16 bp, Artificial Sequence
  synthetic [barcode part1]
ttccgtgtacagagac

SEQ ID NO: 36667 - DNA, 16 bp, Artificial Sequence
  synthetic [barcode part1]
cactctctgtactctg

SEQ ID NO: 36668 - DNA, 16 bp, Artificial Sequence
  synthetic [barcode part1]
gttggtggataacagt

SEQ ID NO: 36669 - DNA, 16 bp, Artificial Sequence
  synthetic [barcode part1]
actccgcgtaaccgtt

SEQ ID NO: 36670 - DNA, 16 bp, Artificial Sequence
  synthetic [barcode part1]
attggtcctctgagag

SEQ ID NO: 36671 - DNA, 16 bp, Artificial Sequence
  synthetic [barcode part1]
attgccacgtgtcctg

SEQ ID NO: 36672 - DNA, 16 bp, Artificial Sequence
  synthetic [barcode part1]
aacaggagattcacgt

SEQ ID NO: 36673 - DNA, 16 bp, Artificial Sequence
  synthetic [barcode part1]
agaagttgtgccgacg

SEQ ID NO: 36674 - DNA, 16 bp, Artificial Sequence
  synthetic [barcode part1]
tgagaaggtgccgact

SEQ ID NO: 36675 - DNA, 16 bp, Artificial Sequence
  synthetic [barcode part1]
agagtctgaattccgc

SEQ ID NO: 36676 - DNA, 16 bp, Artificial Sequence
  synthetic [barcode part1]
aagatacaactcgacg

SEQ ID NO: 36677 - DNA, 16 bp, Artificial Sequence
  synthetic [barcode part1]
tctcctgtactgatag

SEQ ID NO: 36678 - DNA, 16 bp, Artificial Sequence
  synthetic [barcode part1]
tcgcactgtaagaacc

SEQ ID NO: 36679 - DNA, 16 bp, Artificial Sequence
  synthetic [barcode part1]
tacgtgacgaaggacc

SEQ ID NO: 36680 - DNA, 16 bp, Artificial Sequence
  synthetic [barcode part1]
actgtgagaactccac

SEQ ID NO: 36681 - DNA, 16 bp, Artificial Sequence
  synthetic [barcode part1]
ccgagtactgtgaact

SEQ ID NO: 36682 - DNA, 16 bp, Artificial Sequence
  synthetic [barcode part1]
gtctcgcggattaagt

SEQ ID NO: 36683 - DNA, 16 bp, Artificial Sequence
  synthetic [barcode part1]
cggatagagtaggtag

SEQ ID NO: 36684 - DNA, 16 bp, Artificial Sequence
  synthetic [barcode part1]
aactaccgttcttgtg

SEQ ID NO: 36685 - DNA, 16 bp, Artificial Sequence
  synthetic [barcode part1]
agagtgcagttcgacg

SEQ ID NO: 36686 - DNA, 16 bp, Artificial Sequence
  synthetic [barcode part1]
gttaggcagatcgtct

SEQ ID NO: 36687 - DNA, 16 bp, Artificial Sequence
  synthetic [barcode part1]
gacgaacacgagtaag

SEQ ID NO: 36688 - DNA, 16 bp, Artificial Sequence
  synthetic [barcode part1]
accttagtctctcctg

SEQ ID NO: 36689 - DNA, 16 bp, Artificial Sequence
  synthetic [barcode part1]
aacacggaagttgttg

SEQ ID NO: 36690 - DNA, 16 bp, Artificial Sequence
  synthetic [barcode part1]
tccttaggcacgtcgt

SEQ ID NO: 36691 - DNA, 16 bp, Artificial Sequence
  synthetic [barcode part1]
atcaccttcacggatt

SEQ ID NO: 36692 - DNA, 16 bp, Artificial Sequence
  synthetic [barcode part1]
gcctccgagactattc

SEQ ID NO: 36693 - DNA, 16 bp, Artificial Sequence
  synthetic [barcode part1]
tgcgcgtactaatcag

SEQ ID NO: 36694 - DNA, 16 bp, Artificial Sequence
  synthetic [barcode part1]
tgagaggtcttagtcc

SEQ ID NO: 36695 - DNA, 16 bp, Artificial Sequence
  synthetic [barcode part1]
ttgtatcaacgacctc

SEQ ID NO: 36696 - DNA, 16 bp, Artificial Sequence
  synthetic [barcode part1]
gtgcacgtagtgttac

SEQ ID NO: 36697 - DNA, 16 bp, Artificial Sequence
  synthetic [barcode part1]
aactccacttggaacg

SEQ ID NO: 36698 - DNA, 16 bp, Artificial Sequence
  synthetic [barcode part1]
actgacaacgaggtgc

SEQ ID NO: 36699 - DNA, 16 bp, Artificial Sequence
  synthetic [barcode part1]
tgagacgtagattcag

SEQ ID NO: 36700 - DNA, 16 bp, Artificial Sequence
  synthetic [barcode part1]
tcctataggccgttgc

SEQ ID NO: 36701 - DNA, 16 bp, Artificial Sequence
  synthetic [barcode part1]
gtggttgacactggtt

SEQ ID NO: 36702 - DNA, 16 bp, Artificial Sequence
  synthetic [barcode part1]
cacacaataaggagtc

SEQ ID NO: 36703 - DNA, 16 bp, Artificial Sequence
  synthetic [barcode part1]
ccacggatagatctac

SEQ ID NO: 36704 - DNA, 16 bp, Artificial Sequence
  synthetic [barcode part1]
taacctcgcgccaact

SEQ ID NO: 36705 - DNA, 16 bp, Artificial Sequence
  synthetic [barcode part1]
ttgaagtcactcacct

SEQ ID NO: 36706 - DNA, 16 bp, Artificial Sequence
  synthetic [barcode part1]
acaacggatagttacg

SEQ ID NO: 36707 - DNA, 16 bp, Artificial Sequence
  synthetic [barcode part1]
aatagaggtcgtcctc

SEQ ID NO: 36708 - DNA, 16 bp, Artificial Sequence
  synthetic [barcode part1]
gagagattctggtcct

SEQ ID NO: 36709 - DNA, 16 bp, Artificial Sequence
  synthetic [barcode part1]
tgttgaggagttgtcc

SEQ ID NO: 36710 - DNA, 16 bp, Artificial Sequence
  synthetic [barcode part1]
ttcacttcgaacggag

SEQ ID NO: 36711 - DNA, 16 bp, Artificial Sequence
  synthetic [barcode part1]
ttgagtgttcactacc

SEQ ID NO: 36712 - DNA, 16 bp, Artificial Sequence
  synthetic [barcode part1]
tcgttacgtgacgagt

SEQ ID NO: 36713 - DNA, 16 bp, Artificial Sequence
  synthetic [barcode part1]
tcagtgtgtactgacg

SEQ ID NO: 36714 - DNA, 16 bp, Artificial Sequence
  synthetic [barcode part1]
tattgtcacggttacc

SEQ ID NO: 36715 - DNA, 16 bp, Artificial Sequence
  synthetic [barcode part1]
atagtgtgccgactgt

SEQ ID NO: 36716 - DNA, 16 bp, Artificial Sequence
  synthetic [barcode part1]
gttagtaggaccaagt

SEQ ID NO: 36717 - DNA, 16 bp, Artificial Sequence
  synthetic [barcode part1]
acgatctgcaactcag

SEQ ID NO: 36718 - DNA, 16 bp, Artificial Sequence
  synthetic [barcode part1]
cctccgattgacttct

SEQ ID NO: 36719 - DNA, 16 bp, Artificial Sequence
  synthetic [barcode part1]
acgttgtacagtaccg

SEQ ID NO: 36720 - DNA, 16 bp, Artificial Sequence
  synthetic [barcode part1]
agtaacttctctgcgt

SEQ ID NO: 36721 - DNA, 16 bp, Artificial Sequence
  synthetic [barcode part1]
tcggtcctgagtctgt

SEQ ID NO: 36722 - DNA, 16 bp, Artificial Sequence
  synthetic [barcode part1]
gagaggtcaagttcgc

SEQ ID NO: 36723 - DNA, 16 bp, Artificial Sequence
  synthetic [barcode part1]
cggttgacaataccgt

SEQ ID NO: 36724 - DNA, 16 bp, Artificial Sequence
  synthetic [barcode part1]
gtccttgatccgacac

SEQ ID NO: 36725 - DNA, 16 bp, Artificial Sequence
  synthetic [barcode part1]
gtctctggttcaacgc

SEQ ID NO: 36726 - DNA, 16 bp, Artificial Sequence
  synthetic [barcode part1]
actgtgacctgtctgc

SEQ ID NO: 36727 - DNA, 16 bp, Artificial Sequence
  synthetic [barcode part1]
tctgtgcggaatacac

SEQ ID NO: 36728 - DNA, 16 bp, Artificial Sequence
  synthetic [barcode part1]
cagtcctaccggtatc

SEQ ID NO: 36729 - DNA, 16 bp, Artificial Sequence
  synthetic [barcode part1]
tcagtggaagtgtagt

SEQ ID NO: 36730 - DNA, 16 bp, Artificial Sequence
  synthetic [barcode part1]
acttgcctgttacaac

SEQ ID NO: 36731 - DNA, 16 bp, Artificial Sequence
  synthetic [barcode part1]
gcaacagttaccactg

SEQ ID NO: 36732 - DNA, 16 bp, Artificial Sequence
  synthetic [barcode part1]
actagacgtcctcacc

SEQ ID NO: 36733 - DNA, 16 bp, Artificial Sequence
  synthetic [barcode part1]
agtcacgcgtgcaatt

SEQ ID NO: 36734 - DNA, 16 bp, Artificial Sequence
  synthetic [barcode part1]
gtccaccttcacttgt

SEQ ID NO: 36735 - DNA, 16 bp, Artificial Sequence
  synthetic [barcode part1]
cgtgatattgcgacac

SEQ ID NO: 36736 - DNA, 16 bp, Artificial Sequence
  synthetic [barcode part1]
aacgtgtgccgatatc

SEQ ID NO: 36737 - DNA, 16 bp, Artificial Sequence
  synthetic [barcode part1]
gatacctacaaccacg

SEQ ID NO: 36738 - DNA, 16 bp, Artificial Sequence
  synthetic [barcode part1]
taggactacacacacc

SEQ ID NO: 36739 - DNA, 16 bp, Artificial Sequence
  synthetic [barcode part1]
cctgacgtgtcttcag

SEQ ID NO: 36740 - DNA, 16 bp, Artificial Sequence
  synthetic [barcode part1]
gcgtcctctggtagtt

SEQ ID NO: 36741 - DNA, 16 bp, Artificial Sequence
  synthetic [barcode part1]
atacttctcctgcgtc

SEQ ID NO: 36742 - DNA, 16 bp, Artificial Sequence
  synthetic [barcode part1]
ttcgaacggatactcg

SEQ ID NO: 36743 - DNA, 16 bp, Artificial Sequence
  synthetic [barcode part1]
agtcctaggcaggtag

SEQ ID NO: 36744 - DNA, 16 bp, Artificial Sequence
  synthetic [barcode part1]
actcgtcgaacttcgc

SEQ ID NO: 36745 - DNA, 16 bp, Artificial Sequence
  synthetic [barcode part1]
tattgtccggaggatc

SEQ ID NO: 36746 - DNA, 16 bp, Artificial Sequence
  synthetic [barcode part1]
tcactgaattaggccg

SEQ ID NO: 36747 - DNA, 16 bp, Artificial Sequence
  synthetic [barcode part1]
caacgatcgattcgac

SEQ ID NO: 36748 - DNA, 16 bp, Artificial Sequence
  synthetic [barcode part1]
cacgaagtccttacag

SEQ ID NO: 36749 - DNA, 16 bp, Artificial Sequence
  synthetic [barcode part1]
gtgagtgacgacactg

SEQ ID NO: 36750 - DNA, 16 bp, Artificial Sequence
  synthetic [barcode part1]
tgtgccgtatacagtg

SEQ ID NO: 36751 - DNA, 16 bp, Artificial Sequence
  synthetic [barcode part1]
tgatacgtcgagtgtc

SEQ ID NO: 36752 - DNA, 16 bp, Artificial Sequence
  synthetic [barcode part1]
gtggttgttaactcct

SEQ ID NO: 36753 - DNA, 16 bp, Artificial Sequence
  synthetic [barcode part1]
tacactcacggtccgt

SEQ ID NO: 36754 - DNA, 16 bp, Artificial Sequence
  synthetic [barcode part1]
gtatagttggcgcgtt

SEQ ID NO: 36755 - DNA, 16 bp, Artificial Sequence
  synthetic [barcode part1]
tgtaacggcaacactc

SEQ ID NO: 36756 - DNA, 16 bp, Artificial Sequence
  synthetic [barcode part1]
cgatataggccgtact

SEQ ID NO: 36757 - DNA, 16 bp, Artificial Sequence
  synthetic [barcode part1]
gtcgaagtaaccgcag

SEQ ID NO: 36758 - DNA, 16 bp, Artificial Sequence
  synthetic [barcode part1]
aattggacgaacctag

SEQ ID NO: 36759 - DNA, 16 bp, Artificial Sequence
  synthetic [barcode part1]
tcgcctgatctgtctt

SEQ ID NO: 36760 - DNA, 16 bp, Artificial Sequence
  synthetic [barcode part1]
tgcgcgaagatcgaac

SEQ ID NO: 36761 - DNA, 16 bp, Artificial Sequence
  synthetic [barcode part1]
gcgtgattctcttagt

SEQ ID NO: 36762 - DNA, 16 bp, Artificial Sequence
  synthetic [barcode part1]
gtaacctagatcaccg

SEQ ID NO: 36763 - DNA, 16 bp, Artificial Sequence
  synthetic [barcode part1]
aggtcagtcttgactg

SEQ ID NO: 36764 - DNA, 16 bp, Artificial Sequence
  synthetic [barcode part1]
tcaggtgataggcctt

SEQ ID NO: 36765 - DNA, 16 bp, Artificial Sequence
  synthetic [barcode part1]
aatctgcgtgagtctg

SEQ ID NO: 36766 - DNA, 16 bp, Artificial Sequence
  synthetic [barcode part1]
ccaggcaagataatac

SEQ ID NO: 36767 - DNA, 16 bp, Artificial Sequence
  synthetic [barcode part1]
ttcacttcaaggtctg

SEQ ID NO: 36768 - DNA, 16 bp, Artificial Sequence
  synthetic [barcode part1]
aatcgaaggcgtattg

SEQ ID NO: 36769 - DNA, 16 bp, Artificial Sequence
  synthetic [barcode part1]
ttaccgtctgccttgt

SEQ ID NO: 36770 - DNA, 16 bp, Artificial Sequence
  synthetic [barcode part1]
gcaatcagttagtgcc

SEQ ID NO: 36771 - DNA, 16 bp, Artificial Sequence
  synthetic [barcode part1]
acaactgtggtcacac

SEQ ID NO: 36772 - DNA, 16 bp, Artificial Sequence
  synthetic [barcode part1]
tgatagacaggcgtcg

SEQ ID NO: 36773 - DNA, 16 bp, Artificial Sequence
  synthetic [barcode part1]
agaccacagtggtctt

SEQ ID NO: 36774 - DNA, 16 bp, Artificial Sequence
  synthetic [barcode part1]
taggagacacgtaact

SEQ ID NO: 36775 - DNA, 16 bp, Artificial Sequence
  synthetic [barcode part1]
cgtatagagattggac

SEQ ID NO: 36776 - DNA, 16 bp, Artificial Sequence
  synthetic [barcode part1]
cagtgccttgtgatag

SEQ ID NO: 36777 - DNA, 16 bp, Artificial Sequence
  synthetic [barcode part1]
tcaaggtaacgagtac

SEQ ID NO: 36778 - DNA, 16 bp, Artificial Sequence
  synthetic [barcode part1]
agtgaggaaccacacc

SEQ ID NO: 36779 - DNA, 16 bp, Artificial Sequence
  synthetic [barcode part1]
attcgcctccaggatc

SEQ ID NO: 36780 - DNA, 16 bp, Artificial Sequence
  synthetic [barcode part1]
taggccgtacgttctc

SEQ ID NO: 36781 - DNA, 16 bp, Artificial Sequence
  synthetic [barcode part1]
ttgcggaacggttgtt

SEQ ID NO: 36782 - DNA, 16 bp, Artificial Sequence
  synthetic [barcode part1]
ccacctaagataggtc

SEQ ID NO: 36783 - DNA, 16 bp, Artificial Sequence
  synthetic [barcode part1]
acgtcggccttcaatc

SEQ ID NO: 36784 - DNA, 16 bp, Artificial Sequence
  synthetic [barcode part1]
gcgtgtcctgttactg

SEQ ID NO: 36785 - DNA, 16 bp, Artificial Sequence
  synthetic [barcode part1]
gacaacgttgtcctag

SEQ ID NO: 36786 - DNA, 16 bp, Artificial Sequence
  synthetic [barcode part1]
aacacgttcgaagaac

SEQ ID NO: 36787 - DNA, 16 bp, Artificial Sequence
  synthetic [barcode part1]
cctccgaatactagtt

SEQ ID NO: 36788 - DNA, 16 bp, Artificial Sequence
  synthetic [barcode part1]
gttgtaacctatccgt

SEQ ID NO: 36789 - DNA, 16 bp, Artificial Sequence
  synthetic [barcode part1]
ataacagtgccggcag

SEQ ID NO: 36790 - DNA, 16 bp, Artificial Sequence
  synthetic [barcode part1]
tctcacgaactcggtc

SEQ ID NO: 36791 - DNA, 16 bp, Artificial Sequence
  synthetic [barcode part1]
tagaggaccgattcct

SEQ ID NO: 36792 - DNA, 16 bp, Artificial Sequence
  synthetic [barcode part1]
tgacgttacctgcctg

SEQ ID NO: 36793 - DNA, 16 bp, Artificial Sequence
  synthetic [barcode part1]
tgaagtacgaggagtg

SEQ ID NO: 36794 - DNA, 16 bp, Artificial Sequence
  synthetic [barcode part1]
tcgtatcttcaacggt

SEQ ID NO: 36795 - DNA, 16 bp, Artificial Sequence
  synthetic [barcode part1]
cctgattcttcgacct

SEQ ID NO: 36796 - DNA, 16 bp, Artificial Sequence
  synthetic [barcode part1]
acaaccttaccttcag

SEQ ID NO: 36797 - DNA, 16 bp, Artificial Sequence
  synthetic [barcode part1]
tgagtctcactcagag

SEQ ID NO: 36798 - DNA, 16 bp, Artificial Sequence
  synthetic [barcode part1]
gagtgcaccaacaacg

SEQ ID NO: 36799 - DNA, 16 bp, Artificial Sequence
  synthetic [barcode part1]
ccactaaggtcactag

SEQ ID NO: 36800 - DNA, 16 bp, Artificial Sequence
  synthetic [barcode part1]
tctggaggtgttgtgt

SEQ ID NO: 36801 - DNA, 16 bp, Artificial Sequence
  synthetic [barcode part1]
agtgtgtgactaagac

SEQ ID NO: 36802 - DNA, 16 bp, Artificial Sequence
  synthetic [barcode part1]
gttgagtgtaggaatc

SEQ ID NO: 36803 - DNA, 16 bp, Artificial Sequence
  synthetic [barcode part1]
acggttatacacgacc

SEQ ID NO: 36804 - DNA, 16 bp, Artificial Sequence
  synthetic [barcode part1]
gttcgagaagtggcgt

SEQ ID NO: 36805 - DNA, 16 bp, Artificial Sequence
  synthetic [barcode part1]
gtgcaccacaggatag

SEQ ID NO: 36806 - DNA, 16 bp, Artificial Sequence
  synthetic [barcode part1]
gagacggtcacgagtt

SEQ ID NO: 36807 - DNA, 16 bp, Artificial Sequence
  synthetic [barcode part1]
gatagtcagtccaacc

SEQ ID NO: 36808 - DNA, 16 bp, Artificial Sequence
  synthetic [barcode part1]
gtcctcggacaacctt

SEQ ID NO: 36809 - DNA, 16 bp, Artificial Sequence
  synthetic [barcode part1]
cctatacctaagtcgt

SEQ ID NO: 36810 - DNA, 16 bp, Artificial Sequence
  synthetic [barcode part1]
agattcctcaaggtcg

SEQ ID NO: 36811 - DNA, 16 bp, Artificial Sequence
  synthetic [barcode part1]
cgccttaagtgtctgc

SEQ ID NO: 36812 - DNA, 16 bp, Artificial Sequence
  synthetic [barcode part1]
acagtcacagttgcac

SEQ ID NO: 36813 - DNA, 16 bp, Artificial Sequence
  synthetic [barcode part1]
tccgtcgagagtagtt

SEQ ID NO: 36814 - DNA, 16 bp, Artificial Sequence
  synthetic [barcode part1]
cacaatatccgtctgt

SEQ ID NO: 36815 - DNA, 16 bp, Artificial Sequence
  synthetic [barcode part1]
cctgtgcgttagacct

SEQ ID NO: 36816 - DNA, 16 bp, Artificial Sequence
  synthetic [barcode part1]
tcgatctccacacggt

SEQ ID NO: 36817 - DNA, 16 bp, Artificial Sequence
  synthetic [barcode part1]
aagaagttaccaacgc

SEQ ID NO: 36818 - DNA, 16 bp, Artificial Sequence
  synthetic [barcode part1]
tcgatacaatctctcg

SEQ ID NO: 36819 - DNA, 16 bp, Artificial Sequence
  synthetic [barcode part1]
ccaattctaggttcgt

SEQ ID NO: 36820 - DNA, 16 bp, Artificial Sequence
  synthetic [barcode part1]
gcaaggaagttgttac

SEQ ID NO: 36821 - DNA, 16 bp, Artificial Sequence
  synthetic [barcode part1]
atcagaacgatacgtg

SEQ ID NO: 36822 - DNA, 16 bp, Artificial Sequence
  synthetic [barcode part1]
gcaggagtcgacgatt

SEQ ID NO: 36823 - DNA, 16 bp, Artificial Sequence
  synthetic [barcode part1]
gtccggaaggcaatac

SEQ ID NO: 36824 - DNA, 16 bp, Artificial Sequence
  synthetic [barcode part1]
gttgtgtctgacgtag

SEQ ID NO: 36825 - DNA, 16 bp, Artificial Sequence
  synthetic [barcode part1]
ttcgagagaagtctcc

SEQ ID NO: 36826 - DNA, 16 bp, Artificial Sequence
  synthetic [barcode part1]
agtggccactgttaac

SEQ ID NO: 36827 - DNA, 16 bp, Artificial Sequence
  synthetic [barcode part1]
gaactctagaggagag

SEQ ID NO: 36828 - DNA, 16 bp, Artificial Sequence
  synthetic [barcode part1]
tattcctaatcgccag

SEQ ID NO: 36829 - DNA, 16 bp, Artificial Sequence
  synthetic [barcode part1]
tgcggatcaaggtggt

SEQ ID NO: 36830 - DNA, 16 bp, Artificial Sequence
  synthetic [barcode part1]
acagttgcaacgtgtc

SEQ ID NO: 36831 - DNA, 16 bp, Artificial Sequence
  synthetic [barcode part1]
tggtcctaatctctcc

SEQ ID NO: 36832 - DNA, 16 bp, Artificial Sequence
  synthetic [barcode part1]
actgcgaggtgagtgt

SEQ ID NO: 36833 - DNA, 16 bp, Artificial Sequence
  synthetic [barcode part1]
agtaagtgtggacgag

SEQ ID NO: 36834 - DNA, 16 bp, Artificial Sequence
  synthetic [barcode part1]
gaggtgttaatctgag

SEQ ID NO: 36835 - DNA, 16 bp, Artificial Sequence
  synthetic [barcode part1]
cagagtgacagagtag

SEQ ID NO: 36836 - DNA, 16 bp, Artificial Sequence
  synthetic [barcode part1]
tcttcagtggtgtgtt

SEQ ID NO: 36837 - DNA, 16 bp, Artificial Sequence
  synthetic [barcode part1]
ccagttctaagaggtc

SEQ ID NO: 36838 - DNA, 16 bp, Artificial Sequence
  synthetic [barcode part1]
gaacagaataacgcct

SEQ ID NO: 36839 - DNA, 16 bp, Artificial Sequence
  synthetic [barcode part1]
acaccaacgtaccaac

SEQ ID NO: 36840 - DNA, 16 bp, Artificial Sequence
  synthetic [barcode part1]
tctggtctctcaatcc

SEQ ID NO: 36841 - DNA, 16 bp, Artificial Sequence
  synthetic [barcode part1]
gacggtaattccactg

SEQ ID NO: 36842 - DNA, 16 bp, Artificial Sequence
  synthetic [barcode part1]
gcctaggtgttactcc

SEQ ID NO: 36843 - DNA, 16 bp, Artificial Sequence
  synthetic [barcode part1]
agtaccggtcgtaact

SEQ ID NO: 36844 - DNA, 16 bp, Artificial Sequence
  synthetic [barcode part1]
acaagtctggtaagac

SEQ ID NO: 36845 - DNA, 16 bp, Artificial Sequence
  synthetic [barcode part1]
aatcgtgccttccgac

SEQ ID NO: 36846 - DNA, 16 bp, Artificial Sequence
  synthetic [barcode part1]
cagtgtgactgcctct

SEQ ID NO: 36847 - DNA, 16 bp, Artificial Sequence
  synthetic [barcode part1]
gacgagttggaacctg

SEQ ID NO: 36848 - DNA, 16 bp, Artificial Sequence
  synthetic [barcode part1]
taacagactcggatag

SEQ ID NO: 36849 - DNA, 16 bp, Artificial Sequence
  synthetic [barcode part1]
cactactgagtcgagt

SEQ ID NO: 36850 - DNA, 16 bp, Artificial Sequence
  synthetic [barcode part1]
tctaaggtgcgatacc

SEQ ID NO: 36851 - DNA, 16 bp, Artificial Sequence
  synthetic [barcode part1]
gcctatctggaactcc

SEQ ID NO: 36852 - DNA, 16 bp, Artificial Sequence
  synthetic [barcode part1]
tcctaacagttcacgt

SEQ ID NO: 36853 - DNA, 16 bp, Artificial Sequence
  synthetic [barcode part1]
tgttcgaactgcctcg

SEQ ID NO: 36854 - DNA, 16 bp, Artificial Sequence
  synthetic [barcode part1]
caggatcgactctagt

SEQ ID NO: 36855 - DNA, 16 bp, Artificial Sequence
  synthetic [barcode part1]
atacgtaggccagtct

SEQ ID NO: 36856 - DNA, 16 bp, Artificial Sequence
  synthetic [barcode part1]
gccttgtcgtcaacac

SEQ ID NO: 36857 - DNA, 16 bp, Artificial Sequence
  synthetic [barcode part1]
gtgtggacctggtaag

SEQ ID NO: 36858 - DNA, 16 bp, Artificial Sequence
  synthetic [barcode part1]
caacactcgagacttg

SEQ ID NO: 36859 - DNA, 16 bp, Artificial Sequence
  synthetic [barcode part1]
tgatcaccttgcgaag

SEQ ID NO: 36860 - DNA, 16 bp, Artificial Sequence
  synthetic [barcode part1]
atccagtacgttcttg

SEQ ID NO: 36861 - DNA, 16 bp, Artificial Sequence
  synthetic [barcode part1]
gaattcgacggttgtc

SEQ ID NO: 36862 - DNA, 16 bp, Artificial Sequence
  synthetic [barcode part1]
ttgacgattacactcc

SEQ ID NO: 36863 - DNA, 16 bp, Artificial Sequence
  synthetic [barcode part1]
gtggatcgtgtctagt

SEQ ID NO: 36864 - DNA, 16 bp, Artificial Sequence
  synthetic [barcode part1]
gtagacctgcgaatct

SEQ ID NO: 36865 - DNA, 16 bp, Artificial Sequence
  synthetic [barcode part1]
gtaatcgtgacacacc

SEQ ID NO: 36866 - DNA, 16 bp, Artificial Sequence
  synthetic [barcode part1]
gtgcacagtacgtact

SEQ ID NO: 36867 - DNA, 16 bp, Artificial Sequence
  synthetic [barcode part1]
actatcgtggtagtcg

SEQ ID NO: 36868 - DNA, 16 bp, Artificial Sequence
  synthetic [barcode part1]
gtacctctggtagtcc

SEQ ID NO: 36869 - DNA, 16 bp, Artificial Sequence
  synthetic [barcode part1]
cgatcctacgcactac

SEQ ID NO: 36870 - DNA, 16 bp, Artificial Sequence
  synthetic [barcode part1]
gtatcagacactcgac

SEQ ID NO: 36871 - DNA, 16 bp, Artificial Sequence
  synthetic [barcode part1]
aggatcgttcttgacg

SEQ ID NO: 36872 - DNA, 16 bp, Artificial Sequence
  synthetic [barcode part1]
gttggattgcctctgc

SEQ ID NO: 36873 - DNA, 16 bp, Artificial Sequence
  synthetic [barcode part1]
tgatcttcgcggttgc

SEQ ID NO: 36874 - DNA, 16 bp, Artificial Sequence
  synthetic [barcode part1]
acttgtgtaatcctcg

SEQ ID NO: 36875 - DNA, 16 bp, Artificial Sequence
  synthetic [barcode part1]
tacttcaccacggacc

SEQ ID NO: 36876 - DNA, 16 bp, Artificial Sequence
  synthetic [barcode part1]
attcgtccagaactct

SEQ ID NO: 36877 - DNA, 16 bp, Artificial Sequence
  synthetic [barcode part1]
cgacctccaactgtgt

SEQ ID NO: 36878 - DNA, 16 bp, Artificial Sequence
  synthetic [barcode part1]
tcgtagagatacgtcc

SEQ ID NO: 36879 - DNA, 16 bp, Artificial Sequence
  synthetic [barcode part1]
tagagagtcggtcctt

SEQ ID NO: 36880 - DNA, 16 bp, Artificial Sequence
  synthetic [barcode part1]
gcaacttcctgcactg

SEQ ID NO: 36881 - DNA, 16 bp, Artificial Sequence
  synthetic [barcode part1]
ttgacggtaccagact

SEQ ID NO: 36882 - DNA, 16 bp, Artificial Sequence
  synthetic [barcode part1]
cacttgattgagtgcg

SEQ ID NO: 36883 - DNA, 16 bp, Artificial Sequence
  synthetic [barcode part1]
acgaaccaaccacgtt

SEQ ID NO: 36884 - DNA, 16 bp, Artificial Sequence
  synthetic [barcode part1]
tggattcgaacagtag

SEQ ID NO: 36885 - DNA, 16 bp, Artificial Sequence
  synthetic [barcode part1]
tacggactcacgagtt

SEQ ID NO: 36886 - DNA, 16 bp, Artificial Sequence
  synthetic [barcode part1]
gttcgttcgccacagt

SEQ ID NO: 36887 - DNA, 16 bp, Artificial Sequence
  synthetic [barcode part1]
ccgaataacgaacctc

SEQ ID NO: 36888 - DNA, 16 bp, Artificial Sequence
  synthetic [barcode part1]
gagtgacgacttgcag

SEQ ID NO: 36889 - DNA, 16 bp, Artificial Sequence
  synthetic [barcode part1]
gtctcctagagagttg

SEQ ID NO: 36890 - DNA, 16 bp, Artificial Sequence
  synthetic [barcode part1]
tgacggcagaatatac

SEQ ID NO: 36891 - DNA, 16 bp, Artificial Sequence
  synthetic [barcode part1]
cgaaccgtgataactc

SEQ ID NO: 36892 - DNA, 16 bp, Artificial Sequence
  synthetic [barcode part1]
caataacgtgcaaggt

SEQ ID NO: 36893 - DNA, 16 bp, Artificial Sequence
  synthetic [barcode part1]
aggaagaacgtgtgtg

SEQ ID NO: 36894 - DNA, 16 bp, Artificial Sequence
  synthetic [barcode part1]
accacggaacagacac

SEQ ID NO: 36895 - DNA, 16 bp, Artificial Sequence
  synthetic [barcode part1]
ccttagactacgacag

SEQ ID NO: 36896 - DNA, 16 bp, Artificial Sequence
  synthetic [barcode part1]
gtcctactagaaggtc

SEQ ID NO: 36897 - DNA, 16 bp, Artificial Sequence
  synthetic [barcode part1]
taaggccacgtacact

SEQ ID NO: 36898 - DNA, 16 bp, Artificial Sequence
  synthetic [barcode part1]
ccaggatacaggcagt

SEQ ID NO: 36899 - DNA, 16 bp, Artificial Sequence
  synthetic [barcode part1]
gtagaaggtgccttct

SEQ ID NO: 36900 - DNA, 16 bp, Artificial Sequence
  synthetic [barcode part1]
gacctcctgcagactt

SEQ ID NO: 36901 - DNA, 16 bp, Artificial Sequence
  synthetic [barcode part1]
cgaattgaggagtgcc

SEQ ID NO: 36902 - DNA, 16 bp, Artificial Sequence
  synthetic [barcode part1]
cacacgaggatcgagt

SEQ ID NO: 36903 - DNA, 16 bp, Artificial Sequence
  synthetic [barcode part1]
gagttgtgcaatccac

SEQ ID NO: 36904 - DNA, 16 bp, Artificial Sequence
  synthetic [barcode part1]
gtctggcaaggatacg

SEQ ID NO: 36905 - DNA, 16 bp, Artificial Sequence
  synthetic [barcode part1]
aaccacgaatccttct

SEQ ID NO: 36906 - DNA, 16 bp, Artificial Sequence
  synthetic [barcode part1]
taaccgaaggaggaac

SEQ ID NO: 36907 - DNA, 16 bp, Artificial Sequence
  synthetic [barcode part1]
gttcggatagagtagt

SEQ ID NO: 36908 - DNA, 16 bp, Artificial Sequence
  synthetic [barcode part1]
tccagtatcacgtccg

SEQ ID NO: 36909 - DNA, 16 bp, Artificial Sequence
  synthetic [barcode part1]
tgcacttcacctctgt

SEQ ID NO: 36910 - DNA, 16 bp, Artificial Sequence
  synthetic [barcode part1]
tacagaacggcagtcg

SEQ ID NO: 36911 - DNA, 16 bp, Artificial Sequence
  synthetic [barcode part1]
ccgcgaattcaacctc

SEQ ID NO: 36912 - DNA, 16 bp, Artificial Sequence
  synthetic [barcode part1]
cgtgtaggcctaagtt

SEQ ID NO: 36913 - DNA, 16 bp, Artificial Sequence
  synthetic [barcode part1]
cgacgatctgaactgt

SEQ ID NO: 36914 - DNA, 16 bp, Artificial Sequence
  synthetic [barcode part1]
cggtagagttcacgag

SEQ ID NO: 36915 - DNA, 16 bp, Artificial Sequence
  synthetic [barcode part1]
tgagaattaccgaacg

SEQ ID NO: 36916 - DNA, 16 bp, Artificial Sequence
  synthetic [barcode part1]
cgagtgaggataagtg

SEQ ID NO: 36917 - DNA, 16 bp, Artificial Sequence
  synthetic [barcode part1]
caaggtcaggagaagt

SEQ ID NO: 36918 - DNA, 16 bp, Artificial Sequence
  synthetic [barcode part1]
tcttatccagacgttg

SEQ ID NO: 36919 - DNA, 16 bp, Artificial Sequence
  synthetic [barcode part1]
gcgtaataattcctcc

SEQ ID NO: 36920 - DNA, 16 bp, Artificial Sequence
  synthetic [barcode part1]
ttggtggtagaccact

SEQ ID NO: 36921 - DNA, 16 bp, Artificial Sequence
  synthetic [barcode part1]
gtgagagatactcctc

SEQ ID NO: 36922 - DNA, 16 bp, Artificial Sequence
  synthetic [barcode part1]
actacttccgtcttgc

SEQ ID NO: 36923 - DNA, 16 bp, Artificial Sequence
  synthetic [barcode part1]
taggtcttccagacag

SEQ ID NO: 36924 - DNA, 16 bp, Artificial Sequence
  synthetic [barcode part1]
tgacacaggagatcgc

SEQ ID NO: 36925 - DNA, 16 bp, Artificial Sequence
  synthetic [barcode part1]
aaccaactgcagtacc

SEQ ID NO: 36926 - DNA, 16 bp, Artificial Sequence
  synthetic [barcode part1]
actacgtctaggtacg

SEQ ID NO: 36927 - DNA, 16 bp, Artificial Sequence
  synthetic [barcode part1]
aacggagagtccacac

SEQ ID NO: 36928 - DNA, 16 bp, Artificial Sequence
  synthetic [barcode part1]
gcgttctgccgaattc

SEQ ID NO: 36929 - DNA, 16 bp, Artificial Sequence
  synthetic [barcode part1]
acgattgatcacacgc

SEQ ID NO: 36930 - DNA, 16 bp, Artificial Sequence
  synthetic [barcode part1]
tgtcctattcgccgtt

SEQ ID NO: 36931 - DNA, 16 bp, Artificial Sequence
  synthetic [barcode part1]
gagtacttgcctgaac

SEQ ID NO: 36932 - DNA, 16 bp, Artificial Sequence
  synthetic [barcode part1]
tgattggactggttgc

SEQ ID NO: 36933 - DNA, 16 bp, Artificial Sequence
  synthetic [barcode part1]
tcttctcctggaactc

SEQ ID NO: 36934 - DNA, 16 bp, Artificial Sequence
  synthetic [barcode part1]
cgaacgagacaagtag

SEQ ID NO: 36935 - DNA, 16 bp, Artificial Sequence
  synthetic [barcode part1]
gtgtgcgatcaactac

SEQ ID NO: 36936 - DNA, 16 bp, Artificial Sequence
  synthetic [barcode part1]
agaactaccgacgcag

SEQ ID NO: 36937 - DNA, 16 bp, Artificial Sequence
  synthetic [barcode part1]
gtaacgcggtcttagt

SEQ ID NO: 36938 - DNA, 16 bp, Artificial Sequence
  synthetic [barcode part1]
tgtgtcaggttagaag

SEQ ID NO: 36939 - DNA, 16 bp, Artificial Sequence
  synthetic [barcode part1]
ccttgacgacttacgc

SEQ ID NO: 36940 - DNA, 16 bp, Artificial Sequence
  synthetic [barcode part1]
gtgtggatactggacg

SEQ ID NO: 36941 - DNA, 16 bp, Artificial Sequence
  synthetic [barcode part1]
ttcttcctagtcggtc

SEQ ID NO: 36942 - DNA, 16 bp, Artificial Sequence
  synthetic [barcode part1]
agtgtgcggtcaaggt

SEQ ID NO: 36943 - DNA, 16 bp, Artificial Sequence
  synthetic [barcode part1]
accttacgagtgttct

SEQ ID NO: 36944 - DNA, 16 bp, Artificial Sequence
  synthetic [barcode part1]
agaaggacaatcgacg

SEQ ID NO: 36945 - DNA, 16 bp, Artificial Sequence
  synthetic [barcode part1]
cgagaccactataacc

SEQ ID NO: 36946 - DNA, 16 bp, Artificial Sequence
  synthetic [barcode part1]
taacaagacgaactcg

SEQ ID NO: 36947 - DNA, 16 bp, Artificial Sequence
  synthetic [barcode part1]
cgcgcgattcgattct

SEQ ID NO: 36948 - DNA, 16 bp, Artificial Sequence
  synthetic [barcode part1]
taacttcactacgtgc

SEQ ID NO: 36949 - DNA, 16 bp, Artificial Sequence
  synthetic [barcode part1]
cgagtacgatcacact

SEQ ID NO: 36950 - DNA, 16 bp, Artificial Sequence
  synthetic [barcode part1]
ttgcacacaacgtgtg

SEQ ID NO: 36951 - DNA, 16 bp, Artificial Sequence
  synthetic [barcode part1]
cggtagtcgtggaagt

SEQ ID NO: 36952 - DNA, 16 bp, Artificial Sequence
  synthetic [barcode part1]
gactcttgaggactgt

SEQ ID NO: 36953 - DNA, 16 bp, Artificial Sequence
  synthetic [barcode part1]
tcacgtactgactccg

SEQ ID NO: 36954 - DNA, 16 bp, Artificial Sequence
  synthetic [barcode part1]
aacctccgactacgtc

SEQ ID NO: 36955 - DNA, 16 bp, Artificial Sequence
  synthetic [barcode part1]
actatcgtgcaagaag

SEQ ID NO: 36956 - DNA, 16 bp, Artificial Sequence
  synthetic [barcode part1]
cctacctaagttctag

SEQ ID NO: 36957 - DNA, 16 bp, Artificial Sequence
  synthetic [barcode part1]
gacgtactggtgtact

SEQ ID NO: 36958 - DNA, 16 bp, Artificial Sequence
  synthetic [barcode part1]
tcctgaccgtactgac

SEQ ID NO: 36959 - DNA, 16 bp, Artificial Sequence
  synthetic [barcode part1]
cgcctatctgcgatac

SEQ ID NO: 36960 - DNA, 16 bp, Artificial Sequence
  synthetic [barcode part1]
acgcagttgcacgatt

SEQ ID NO: 36961 - DNA, 16 bp, Artificial Sequence
  synthetic [barcode part1]
ttaacggacggagacc

SEQ ID NO: 36962 - DNA, 16 bp, Artificial Sequence
  synthetic [barcode part1]
caactagaattccggc

SEQ ID NO: 36963 - DNA, 16 bp, Artificial Sequence
  synthetic [barcode part1]
cgtgtagttactgtct

SEQ ID NO: 36964 - DNA, 16 bp, Artificial Sequence
  synthetic [barcode part1]
tcacgccttgccaagt

SEQ ID NO: 36965 - DNA, 16 bp, Artificial Sequence
  synthetic [barcode part1]
actcaggcactattct

SEQ ID NO: 36966 - DNA, 16 bp, Artificial Sequence
  synthetic [barcode part1]
tgtggagtgacgactg

SEQ ID NO: 36967 - DNA, 16 bp, Artificial Sequence
  synthetic [barcode part1]
gttatctgagtctgtc

SEQ ID NO: 36968 - DNA, 16 bp, Artificial Sequence
  synthetic [barcode part1]
gattaccgcaggagtg

SEQ ID NO: 36969 - DNA, 16 bp, Artificial Sequence
  synthetic [barcode part1]
cgtccttaatctagtg

SEQ ID NO: 36970 - DNA, 16 bp, Artificial Sequence
  synthetic [barcode part1]
taggttctgaacaccg

SEQ ID NO: 36971 - DNA, 16 bp, Artificial Sequence
  synthetic [barcode part1]
gaatccgaggtcaggt

SEQ ID NO: 36972 - DNA, 16 bp, Artificial Sequence
  synthetic [barcode part1]
acctaccttatccgtc

SEQ ID NO: 36973 - DNA, 16 bp, Artificial Sequence
  synthetic [barcode part1]
ccgaacagacgagact

SEQ ID NO: 36974 - DNA, 16 bp, Artificial Sequence
  synthetic [barcode part1]
tccttcttcgagatcc

SEQ ID NO: 36975 - DNA, 16 bp, Artificial Sequence
  synthetic [barcode part1]
atcacggagatagact

SEQ ID NO: 36976 - DNA, 16 bp, Artificial Sequence
  synthetic [barcode part1]
taactgccttacggag

SEQ ID NO: 36977 - DNA, 16 bp, Artificial Sequence
  synthetic [barcode part1]
ttctgactcagacact

SEQ ID NO: 36978 - DNA, 16 bp, Artificial Sequence
  synthetic [barcode part1]
actggtatatctcacc

SEQ ID NO: 36979 - DNA, 16 bp, Artificial Sequence
  synthetic [barcode part1]
gtgaacttctccaatc

SEQ ID NO: 36980 - DNA, 16 bp, Artificial Sequence
  synthetic [barcode part1]
taagtgataggatccg

SEQ ID NO: 36981 - DNA, 16 bp, Artificial Sequence
  synthetic [barcode part1]
aagagtaaggcgcaac

SEQ ID NO: 36982 - DNA, 16 bp, Artificial Sequence
  synthetic [barcode part1]
tgaccagagaggaagt

SEQ ID NO: 36983 - DNA, 16 bp, Artificial Sequence
  synthetic [barcode part1]
ttccagtctagtgtgt

SEQ ID NO: 36984 - DNA, 16 bp, Artificial Sequence
  synthetic [barcode part1]
gtagattgcacgacct

SEQ ID NO: 36985 - DNA, 16 bp, Artificial Sequence
  synthetic [barcode part1]
cacgacaacttgtctt

SEQ ID NO: 36986 - DNA, 16 bp, Artificial Sequence
  synthetic [barcode part1]
gccacctatagattct

SEQ ID NO: 36987 - DNA, 16 bp, Artificial Sequence
  synthetic [barcode part1]
agacctgatcttctgt

SEQ ID NO: 36988 - DNA, 16 bp, Artificial Sequence
  synthetic [barcode part1]
tggactacggttcaac

SEQ ID NO: 36989 - DNA, 16 bp, Artificial Sequence
  synthetic [barcode part1]
tcacagtgaggtcttg

SEQ ID NO: 36990 - DNA, 16 bp, Artificial Sequence
  synthetic [barcode part1]
aaggttccaggacttc

SEQ ID NO: 36991 - DNA, 16 bp, Artificial Sequence
  synthetic [barcode part1]
acacgcgtaatcaacc

SEQ ID NO: 36992 - DNA, 16 bp, Artificial Sequence
  synthetic [barcode part1]
cgacagatactgttcg

SEQ ID NO: 36993 - DNA, 16 bp, Artificial Sequence
  synthetic [barcode part1]
tggtcaaggtcaactc

SEQ ID NO: 36994 - DNA, 16 bp, Artificial Sequence
  synthetic [barcode part1]
gtcttgtctcgactct

SEQ ID NO: 36995 - DNA, 16 bp, Artificial Sequence
  synthetic [barcode part1]
acaccgaagttcacgt

SEQ ID NO: 36996 - DNA, 16 bp, Artificial Sequence
  synthetic [barcode part1]
taccaactatacggcg

SEQ ID NO: 36997 - DNA, 16 bp, Artificial Sequence
  synthetic [barcode part1]
tgttcgaacacagtcg

SEQ ID NO: 36998 - DNA, 16 bp, Artificial Sequence
  synthetic [barcode part1]
cagtcgaacactacgt

SEQ ID NO: 36999 - DNA, 16 bp, Artificial Sequence
  synthetic [barcode part1]
agtcgtggttacacgt

SEQ ID NO: 37000 - DNA, 16 bp, Artificial Sequence
  synthetic [barcode part1]
cacggatcgaacactt

SEQ ID NO: 37001 - DNA, 16 bp, Artificial Sequence
  synthetic [barcode part1]
acggcgttgtatacac

SEQ ID NO: 37002 - DNA, 16 bp, Artificial Sequence
  synthetic [barcode part1]
cgataacggaatacac

SEQ ID NO: 37003 - DNA, 16 bp, Artificial Sequence
  synthetic [barcode part1]
ccaggcgtatcgtctt

SEQ ID NO: 37004 - DNA, 16 bp, Artificial Sequence
  synthetic [barcode part1]
gaatagtccagatacg

SEQ ID NO: 37005 - DNA, 16 bp, Artificial Sequence
  synthetic [barcode part1]
gaccaactggtcagtt

SEQ ID NO: 37006 - DNA, 16 bp, Artificial Sequence
  synthetic [barcode part1]
gacttgttgccacctg

SEQ ID NO: 37007 - DNA, 16 bp, Artificial Sequence
  synthetic [barcode part1]
atcttgttgccggcac

SEQ ID NO: 37008 - DNA, 16 bp, Artificial Sequence
  synthetic [barcode part1]
tgtcggacttgtactt

SEQ ID NO: 37009 - DNA, 16 bp, Artificial Sequence
  synthetic [barcode part1]
ccgtatagtacaccag

SEQ ID NO: 37010 - DNA, 16 bp, Artificial Sequence
  synthetic [barcode part1]
atacggtgagattgac

SEQ ID NO: 37011 - DNA, 16 bp, Artificial Sequence
  synthetic [barcode part1]
tcctagataagtggag

SEQ ID NO: 37012 - DNA, 16 bp, Artificial Sequence
  synthetic [barcode part1]
ccaatacctctgaccg

SEQ ID NO: 37013 - DNA, 16 bp, Artificial Sequence
  synthetic [barcode part1]
cctacgtagtccgatc

SEQ ID NO: 37014 - DNA, 16 bp, Artificial Sequence
  synthetic [barcode part1]
aagttgcgatataggc

SEQ ID NO: 37015 - DNA, 16 bp, Artificial Sequence
  synthetic [barcode part1]
cgccaacttctagtcg

SEQ ID NO: 37016 - DNA, 16 bp, Artificial Sequence
  synthetic [barcode part1]
gcaccgaggaatagtc

SEQ ID NO: 37017 - DNA, 16 bp, Artificial Sequence
  synthetic [barcode part1]
atagactcgcgaacct

SEQ ID NO: 37018 - DNA, 16 bp, Artificial Sequence
  synthetic [barcode part1]
aatattggcgttgcgc

SEQ ID NO: 37019 - DNA, 16 bp, Artificial Sequence
  synthetic [barcode part1]
aattatcaacgcggag

SEQ ID NO: 37020 - DNA, 16 bp, Artificial Sequence
  synthetic [barcode part1]
gataccttattctgcg

SEQ ID NO: 37021 - DNA, 16 bp, Artificial Sequence
  synthetic [barcode part1]
agaactcctcacctgc

SEQ ID NO: 37022 - DNA, 16 bp, Artificial Sequence
  synthetic [barcode part1]
gtagtacgatcttggc

SEQ ID NO: 37023 - DNA, 16 bp, Artificial Sequence
  synthetic [barcode part1]
tacaacggcctactcc

SEQ ID NO: 37024 - DNA, 16 bp, Artificial Sequence
  synthetic [barcode part1]
gacgaggtcagtgtgt

SEQ ID NO: 37025 - DNA, 16 bp, Artificial Sequence
  synthetic [barcode part1]
tggaactgttacggtc

SEQ ID NO: 37026 - DNA, 16 bp, Artificial Sequence
  synthetic [barcode part1]
tcctcgagttgtacgc

SEQ ID NO: 37027 - DNA, 16 bp, Artificial Sequence
  synthetic [barcode part1]
gttggtaggatacctc

SEQ ID NO: 37028 - DNA, 16 bp, Artificial Sequence
  synthetic [barcode part1]
tgccttagaactcgtt

SEQ ID NO: 37029 - DNA, 16 bp, Artificial Sequence
  synthetic [barcode part1]
tctgttggtgttcagt

SEQ ID NO: 37030 - DNA, 16 bp, Artificial Sequence
  synthetic [barcode part1]
cgatcgcgtagaacag

SEQ ID NO: 37031 - DNA, 16 bp, Artificial Sequence
  synthetic [barcode part1]
taggccaggaacgtgt

SEQ ID NO: 37032 - DNA, 16 bp, Artificial Sequence
  synthetic [barcode part1]
aacggtgacggacttg

SEQ ID NO: 37033 - DNA, 16 bp, Artificial Sequence
  synthetic [barcode part1]
cgtgagacgactcaag

SEQ ID NO: 37034 - DNA, 16 bp, Artificial Sequence
  synthetic [barcode part1]
ttcttgtcagatcacg

SEQ ID NO: 37035 - DNA, 16 bp, Artificial Sequence
  synthetic [barcode part1]
tcacacaaccacacag

SEQ ID NO: 37036 - DNA, 16 bp, Artificial Sequence
  synthetic [barcode part1]
caaggagagtcaagac

SEQ ID NO: 37037 - DNA, 16 bp, Artificial Sequence
  synthetic [barcode part1]
tcactgtggcaaggtt

SEQ ID NO: 37038 - DNA, 16 bp, Artificial Sequence
  synthetic [barcode part1]
cggataggcagtatcg

SEQ ID NO: 37039 - DNA, 16 bp, Artificial Sequence
  synthetic [barcode part1]
tagtctgcaggttgtg

SEQ ID NO: 37040 - DNA, 16 bp, Artificial Sequence
  synthetic [barcode part1]
tacggaccttgagtgt

SEQ ID NO: 37041 - DNA, 16 bp, Artificial Sequence
  synthetic [barcode part1]
gagtgttagacttgcc

SEQ ID NO: 37042 - DNA, 16 bp, Artificial Sequence
  synthetic [barcode part1]
ccgtctggataccact

SEQ ID NO: 37043 - DNA, 16 bp, Artificial Sequence
  synthetic [barcode part1]
aagtgaattcgtccgc

SEQ ID NO: 37044 - DNA, 16 bp, Artificial Sequence
  synthetic [barcode part1]
gtcagaggttaacgcg

SEQ ID NO: 37045 - DNA, 16 bp, Artificial Sequence
  synthetic [barcode part1]
tcaattctcgcgtaac

SEQ ID NO: 37046 - DNA, 16 bp, Artificial Sequence
  synthetic [barcode part1]
caactaccgttccacg

SEQ ID NO: 37047 - DNA, 16 bp, Artificial Sequence
  synthetic [barcode part1]
cagtagttctcgcgtc

SEQ ID NO: 37048 - DNA, 16 bp, Artificial Sequence
  synthetic [barcode part1]
tatctcacaggtatcc

SEQ ID NO: 37049 - DNA, 16 bp, Artificial Sequence
  synthetic [barcode part1]
aatctcgttgtctgtg

SEQ ID NO: 37050 - DNA, 16 bp, Artificial Sequence
  synthetic [barcode part1]
aggacgttcagtgacg

SEQ ID NO: 37051 - DNA, 16 bp, Artificial Sequence
  synthetic [barcode part1]
ttgcctgcaaggtctc

SEQ ID NO: 37052 - DNA, 16 bp, Artificial Sequence
  synthetic [barcode part1]
gtacgttgtggaatag

SEQ ID NO: 37053 - DNA, 16 bp, Artificial Sequence
  synthetic [barcode part1]
ccaactacaatcgacg

SEQ ID NO: 37054 - DNA, 16 bp, Artificial Sequence
  synthetic [barcode part1]
tgacttctaaccgtgt

SEQ ID NO: 37055 - DNA, 16 bp, Artificial Sequence
  synthetic [barcode part1]
tgcaacacctacctgc

SEQ ID NO: 37056 - DNA, 16 bp, Artificial Sequence
  synthetic [barcode part1]
acgaacttctctaacc

SEQ ID NO: 37057 - DNA, 16 bp, Artificial Sequence
  synthetic [barcode part1]
ccgtatcgcaactcac

SEQ ID NO: 37058 - DNA, 16 bp, Artificial Sequence
  synthetic [barcode part1]
ttctacttggacgccg

SEQ ID NO: 37059 - DNA, 16 bp, Artificial Sequence
  synthetic [barcode part1]
gacgtcaacgtacact

SEQ ID NO: 37060 - DNA, 16 bp, Artificial Sequence
  synthetic [barcode part1]
cctacactcgagttgc

SEQ ID NO: 37061 - DNA, 16 bp, Artificial Sequence
  synthetic [barcode part1]
acttaggtggacgttc

SEQ ID NO: 37062 - DNA, 16 bp, Artificial Sequence
  synthetic [barcode part1]
gcaggtcgtattcaac

SEQ ID NO: 37063 - DNA, 16 bp, Artificial Sequence
  synthetic [barcode part1]
atcagacacttggtgc

SEQ ID NO: 37064 - DNA, 16 bp, Artificial Sequence
  synthetic [barcode part1]
ccgtaggtactctacc

SEQ ID NO: 37065 - DNA, 16 bp, Artificial Sequence
  synthetic [barcode part1]
ttctgcgaacttaacc

SEQ ID NO: 37066 - DNA, 16 bp, Artificial Sequence
  synthetic [barcode part1]
cgtctaagacctacag

SEQ ID NO: 37067 - DNA, 16 bp, Artificial Sequence
  synthetic [barcode part1]
gttgacttgcagtgtg

SEQ ID NO: 37068 - DNA, 16 bp, Artificial Sequence
  synthetic [barcode part1]
atatcgcgtgacactg

SEQ ID NO: 37069 - DNA, 16 bp, Artificial Sequence
  synthetic [barcode part1]
acctctcagagtcaag

SEQ ID NO: 37070 - DNA, 16 bp, Artificial Sequence
  synthetic [barcode part1]
cggacaccgatagaac

SEQ ID NO: 37071 - DNA, 16 bp, Artificial Sequence
  synthetic [barcode part1]
tgtgacaacgagtggc

SEQ ID NO: 37072 - DNA, 16 bp, Artificial Sequence
  synthetic [barcode part1]
tacggcgcacctattc

SEQ ID NO: 37073 - DNA, 16 bp, Artificial Sequence
  synthetic [barcode part1]
tccgcgtctggtagtt

SEQ ID NO: 37074 - DNA, 16 bp, Artificial Sequence
  synthetic [barcode part1]
cgttgtaagttccgag

SEQ ID NO: 37075 - DNA, 16 bp, Artificial Sequence
  synthetic [barcode part1]
aattgagaacgcactg

SEQ ID NO: 37076 - DNA, 16 bp, Artificial Sequence
  synthetic [barcode part1]
cactgtccttgtggac

SEQ ID NO: 37077 - DNA, 16 bp, Artificial Sequence
  synthetic [barcode part1]
cgtaccgtacaactag

SEQ ID NO: 37078 - DNA, 16 bp, Artificial Sequence
  synthetic [barcode part1]
cgtcctgaggtctact

SEQ ID NO: 37079 - DNA, 16 bp, Artificial Sequence
  synthetic [barcode part1]
gtgtgtgacgtgtact

SEQ ID NO: 37080 - DNA, 16 bp, Artificial Sequence
  synthetic [barcode part1]
tcggcaaggatatagt

SEQ ID NO: 37081 - DNA, 16 bp, Artificial Sequence
  synthetic [barcode part1]
gacgtgcaatccttcc

SEQ ID NO: 37082 - DNA, 16 bp, Artificial Sequence
  synthetic [barcode part1]
caagttcgttccgtcg

SEQ ID NO: 37083 - DNA, 16 bp, Artificial Sequence
  synthetic [barcode part1]
cactgttggcgatagt

SEQ ID NO: 37084 - DNA, 16 bp, Artificial Sequence
  synthetic [barcode part1]
gaatccaatccaggtc

SEQ ID NO: 37085 - DNA, 16 bp, Artificial Sequence
  synthetic [barcode part1]
tacctagtacgtcgag

SEQ ID NO: 37086 - DNA, 16 bp, Artificial Sequence
  synthetic [barcode part1]
aagtgtcctacgagtc

SEQ ID NO: 37087 - DNA, 16 bp, Artificial Sequence
  synthetic [barcode part1]
gtatccaatccacgag

SEQ ID NO: 37088 - DNA, 16 bp, Artificial Sequence
  synthetic [barcode part1]
gtctcactagacctgc

SEQ ID NO: 37089 - DNA, 16 bp, Artificial Sequence
  synthetic [barcode part1]
aatataccggtgtgcc

SEQ ID NO: 37090 - DNA, 16 bp, Artificial Sequence
  synthetic [barcode part1]
cagttggactggttgt

SEQ ID NO: 37091 - DNA, 16 bp, Artificial Sequence
  synthetic [barcode part1]
tactgccttgtacggc

SEQ ID NO: 37092 - DNA, 16 bp, Artificial Sequence
  synthetic [barcode part1]
gtgaggtgtagactcg

SEQ ID NO: 37093 - DNA, 16 bp, Artificial Sequence
  synthetic [barcode part1]
gtggaacaataaggcg

SEQ ID NO: 37094 - DNA, 16 bp, Artificial Sequence
  synthetic [barcode part1]
cagtgcagatcgtgtt

SEQ ID NO: 37095 - DNA, 16 bp, Artificial Sequence
  synthetic [barcode part1]
acttgttccgtaacac

SEQ ID NO: 37096 - DNA, 16 bp, Artificial Sequence
  synthetic [barcode part1]
tgtgacttcagacgtg

SEQ ID NO: 37097 - DNA, 16 bp, Artificial Sequence
  synthetic [barcode part1]
ttgtcgttgaacacct

SEQ ID NO: 37098 - DNA, 16 bp, Artificial Sequence
  synthetic [barcode part1]
caagtgcgaagtgatt

SEQ ID NO: 37099 - DNA, 16 bp, Artificial Sequence
  synthetic [barcode part1]
cgtgcaacgaattcgt

SEQ ID NO: 37100 - DNA, 16 bp, Artificial Sequence
  synthetic [barcode part1]
cctcgtaagtcactgc

SEQ ID NO: 37101 - DNA, 16 bp, Artificial Sequence
  synthetic [barcode part1]
ccggaggtcagtatag

SEQ ID NO: 37102 - DNA, 16 bp, Artificial Sequence
  synthetic [barcode part1]
aggacctcactcgtct

SEQ ID NO: 37103 - DNA, 16 bp, Artificial Sequence
  synthetic [barcode part1]
tggtctcgtcgatacc

SEQ ID NO: 37104 - DNA, 16 bp, Artificial Sequence
  synthetic [barcode part1]
acgtgattgcgactac

SEQ ID NO: 37105 - DNA, 16 bp, Artificial Sequence
  synthetic [barcode part1]
aagagtacggaccacc

SEQ ID NO: 37106 - DNA, 16 bp, Artificial Sequence
  synthetic [barcode part1]
aacactgtacgtacgc

SEQ ID NO: 37107 - DNA, 16 bp, Artificial Sequence
  synthetic [barcode part1]
taacgaccgcagagac

SEQ ID NO: 37108 - DNA, 16 bp, Artificial Sequence
  synthetic [barcode part1]
taagttagaccgtcgc

SEQ ID NO: 37109 - DNA, 16 bp, Artificial Sequence
  synthetic [barcode part1]
aggactccaggtaggt

SEQ ID NO: 37110 - DNA, 16 bp, Artificial Sequence
  synthetic [barcode part1]
cctcctatcactatcg

SEQ ID NO: 37111 - DNA, 16 bp, Artificial Sequence
  synthetic [barcode part1]
agacctacactctgcc

SEQ ID NO: 37112 - DNA, 16 bp, Artificial Sequence
  synthetic [barcode part1]
cagtccttggcgtatc

SEQ ID NO: 37113 - DNA, 16 bp, Artificial Sequence
  synthetic [barcode part1]
gatccggtcgataatc

SEQ ID NO: 37114 - DNA, 16 bp, Artificial Sequence
  synthetic [barcode part1]
accaacgaggtcgagt

SEQ ID NO: 37115 - DNA, 16 bp, Artificial Sequence
  synthetic [barcode part1]
ttgaagagtgtccaag

SEQ ID NO: 37116 - DNA, 16 bp, Artificial Sequence
  synthetic [barcode part1]
gaaggaataactggcg

SEQ ID NO: 37117 - DNA, 16 bp, Artificial Sequence
  synthetic [barcode part1]
ttgaatatccgtcgtc

SEQ ID NO: 37118 - DNA, 16 bp, Artificial Sequence
  synthetic [barcode part1]
tactgacgttgcacag

SEQ ID NO: 37119 - DNA, 16 bp, Artificial Sequence
  synthetic [barcode part1]
gtagaccgccaagagt

SEQ ID NO: 37120 - DNA, 16 bp, Artificial Sequence
  synthetic [barcode part1]
atcagtacgccaacgt

SEQ ID NO: 37121 - DNA, 16 bp, Artificial Sequence
  synthetic [barcode part1]
gttggtacaagtctgc

SEQ ID NO: 37122 - DNA, 16 bp, Artificial Sequence
  synthetic [barcode part1]
acagaatcgagtgttg

SEQ ID NO: 37123 - DNA, 16 bp, Artificial Sequence
  synthetic [barcode part1]
taacgtactccgccgt

SEQ ID NO: 37124 - DNA, 16 bp, Artificial Sequence
  synthetic [barcode part1]
actgtacgactcgtag

SEQ ID NO: 37125 - DNA, 16 bp, Artificial Sequence
  synthetic [barcode part1]
tagactacacgtcctt

SEQ ID NO: 37126 - DNA, 16 bp, Artificial Sequence
  synthetic [barcode part1]
acactccgttggactc

SEQ ID NO: 37127 - DNA, 16 bp, Artificial Sequence
  synthetic [barcode part1]
aacggttgatcgttgc

SEQ ID NO: 37128 - DNA, 16 bp, Artificial Sequence
  synthetic [barcode part1]
atatcgaggagtgact

SEQ ID NO: 37129 - DNA, 16 bp, Artificial Sequence
  synthetic [barcode part1]
gacgagaatacaatcc

SEQ ID NO: 37130 - DNA, 16 bp, Artificial Sequence
  synthetic [barcode part1]
caacggcctcctatac

SEQ ID NO: 37131 - DNA, 16 bp, Artificial Sequence
  synthetic [barcode part1]
aacgactagtccgatc

SEQ ID NO: 37132 - DNA, 16 bp, Artificial Sequence
  synthetic [barcode part1]
cctgactacactaatc

SEQ ID NO: 37133 - DNA, 16 bp, Artificial Sequence
  synthetic [barcode part1]
cggactatcctgcgtt

SEQ ID NO: 37134 - DNA, 16 bp, Artificial Sequence
  synthetic [barcode part1]
cctagtcaagaggttc

SEQ ID NO: 37135 - DNA, 16 bp, Artificial Sequence
  synthetic [barcode part1]
attcctgcctgcactt

SEQ ID NO: 37136 - DNA, 16 bp, Artificial Sequence
  synthetic [barcode part1]
ttgaggtcagagtctc

SEQ ID NO: 37137 - DNA, 16 bp, Artificial Sequence
  synthetic [barcode part1]
ttatcgtactccgtcc

SEQ ID NO: 37138 - DNA, 16 bp, Artificial Sequence
  synthetic [barcode part1]
gagactcctgtagtgt

SEQ ID NO: 37139 - DNA, 16 bp, Artificial Sequence
  synthetic [barcode part1]
tcttctctgatcgacc

SEQ ID NO: 37140 - DNA, 16 bp, Artificial Sequence
  synthetic [barcode part1]
tacggattatcgtctc

SEQ ID NO: 37141 - DNA, 16 bp, Artificial Sequence
  synthetic [barcode part1]
tagtcttcgtagttgc

SEQ ID NO: 37142 - DNA, 16 bp, Artificial Sequence
  synthetic [barcode part1]
ttgaagtccgcaacgt

SEQ ID NO: 37143 - DNA, 16 bp, Artificial Sequence
  synthetic [barcode part1]
gcagtcgatactgatc

SEQ ID NO: 37144 - DNA, 16 bp, Artificial Sequence
  synthetic [barcode part1]
ttggttcctactgcct

SEQ ID NO: 37145 - DNA, 16 bp, Artificial Sequence
  synthetic [barcode part1]
ccaacggcctatactc

SEQ ID NO: 37146 - DNA, 16 bp, Artificial Sequence
  synthetic [barcode part1]
aggatctggtactgtc

SEQ ID NO: 37147 - DNA, 16 bp, Artificial Sequence
  synthetic [barcode part1]
tgattgcagtacgtcg

SEQ ID NO: 37148 - DNA, 16 bp, Artificial Sequence
  synthetic [barcode part1]
tagtcgtgtaagacag

SEQ ID NO: 37149 - DNA, 16 bp, Artificial Sequence
  synthetic [barcode part1]
gtctgaagatagagtc

SEQ ID NO: 37150 - DNA, 16 bp, Artificial Sequence
  synthetic [barcode part1]
tgttgttgtccttcgc

SEQ ID NO: 37151 - DNA, 16 bp, Artificial Sequence
  synthetic [barcode part1]
tctacgactataggcg

SEQ ID NO: 37152 - DNA, 16 bp, Artificial Sequence
  synthetic [barcode part1]
atagagtcgtcactcg

SEQ ID NO: 37153 - DNA, 16 bp, Artificial Sequence
  synthetic [barcode part1]
tacgtgatatcggtgc

SEQ ID NO: 37154 - DNA, 16 bp, Artificial Sequence
  synthetic [barcode part1]
gtcgtctgtctgcaac

SEQ ID NO: 37155 - DNA, 16 bp, Artificial Sequence
  synthetic [barcode part1]
gaggatattcgcgtct

SEQ ID NO: 37156 - DNA, 16 bp, Artificial Sequence
  synthetic [barcode part1]
aactctgacaagtgag

SEQ ID NO: 37157 - DNA, 16 bp, Artificial Sequence
  synthetic [barcode part1]
aatcacctcgcgtctg

SEQ ID NO: 37158 - DNA, 16 bp, Artificial Sequence
  synthetic [barcode part1]
tcctaatctccgttgc

SEQ ID NO: 37159 - DNA, 16 bp, Artificial Sequence
  synthetic [barcode part1]
ttgtgcacaaccacag

SEQ ID NO: 37160 - DNA, 16 bp, Artificial Sequence
  synthetic [barcode part1]
aatctaacggtctggc

SEQ ID NO: 37161 - DNA, 16 bp, Artificial Sequence
  synthetic [barcode part1]
actgcctgcctacaac

SEQ ID NO: 37162 - DNA, 16 bp, Artificial Sequence
  synthetic [barcode part1]
gtcagatacctccgtc

SEQ ID NO: 37163 - DNA, 16 bp, Artificial Sequence
  synthetic [barcode part1]
tgcgttcgataacttc

SEQ ID NO: 37164 - DNA, 16 bp, Artificial Sequence
  synthetic [barcode part1]
actagtactacgcggt

SEQ ID NO: 37165 - DNA, 16 bp, Artificial Sequence
  synthetic [barcode part1]
gtacgcctcactgttg

SEQ ID NO: 37166 - DNA, 16 bp, Artificial Sequence
  synthetic [barcode part1]
tcaggataggtgaatc

SEQ ID NO: 37167 - DNA, 16 bp, Artificial Sequence
  synthetic [barcode part1]
tcctcctatacgcgtt

SEQ ID NO: 37168 - DNA, 16 bp, Artificial Sequence
  synthetic [barcode part1]
gttggcactactatct

SEQ ID NO: 37169 - DNA, 16 bp, Artificial Sequence
  synthetic [barcode part1]
cgccacttagatccgt

SEQ ID NO: 37170 - DNA, 16 bp, Artificial Sequence
  synthetic [barcode part1]
atctggtgccgttaag

SEQ ID NO: 37171 - DNA, 16 bp, Artificial Sequence
  synthetic [barcode part1]
accaatcgcactacag

SEQ ID NO: 37172 - DNA, 16 bp, Artificial Sequence
  synthetic [barcode part1]
cgtagttactaaggag

SEQ ID NO: 37173 - DNA, 16 bp, Artificial Sequence
  synthetic [barcode part1]
caacttcgagaccagt

SEQ ID NO: 37174 - DNA, 16 bp, Artificial Sequence
  synthetic [barcode part1]
aaccacgaaggaactt

SEQ ID NO: 37175 - DNA, 16 bp, Artificial Sequence
  synthetic [barcode part1]
tagactgtcagatcgc

SEQ ID NO: 37176 - DNA, 16 bp, Artificial Sequence
  synthetic [barcode part1]
agttaagacaaccacg

SEQ ID NO: 37177 - DNA, 16 bp, Artificial Sequence
  synthetic [barcode part1]
tgtaagaactgagtcg

SEQ ID NO: 37178 - DNA, 16 bp, Artificial Sequence
  synthetic [barcode part1]
acgagttgattgcacc

SEQ ID NO: 37179 - DNA, 16 bp, Artificial Sequence
  synthetic [barcode part1]
gagatcgcgcgttaag

SEQ ID NO: 37180 - DNA, 16 bp, Artificial Sequence
  synthetic [barcode part1]
tcacagttgcacacag

SEQ ID NO: 37181 - DNA, 16 bp, Artificial Sequence
  synthetic [barcode part1]
atcggacactcaacgt

SEQ ID NO: 37182 - DNA, 16 bp, Artificial Sequence
  synthetic [barcode part1]
cgacgcgaagacagtt

SEQ ID NO: 37183 - DNA, 16 bp, Artificial Sequence
  synthetic [barcode part1]
ttgtgtgcagtgtacg

SEQ ID NO: 37184 - DNA, 16 bp, Artificial Sequence
  synthetic [barcode part1]
ccgccggaattattag

SEQ ID NO: 37185 - DNA, 16 bp, Artificial Sequence
  synthetic [barcode part1]
gtccgtgtacaagttg

SEQ ID NO: 37186 - DNA, 16 bp, Artificial Sequence
  synthetic [barcode part1]
aaccaactcgagatcc

SEQ ID NO: 37187 - DNA, 16 bp, Artificial Sequence
  synthetic [barcode part1]
agttgtcgatacgaag

SEQ ID NO: 37188 - DNA, 16 bp, Artificial Sequence
  synthetic [barcode part1]
tcttggtgcgcagtct

SEQ ID NO: 37189 - DNA, 16 bp, Artificial Sequence
  synthetic [barcode part1]
aagaataggcgcaggt

SEQ ID NO: 37190 - DNA, 16 bp, Artificial Sequence
  synthetic [barcode part1]
tagagattagaccacg

SEQ ID NO: 37191 - DNA, 16 bp, Artificial Sequence
  synthetic [barcode part1]
tgtgaacgaacggtgc

SEQ ID NO: 37192 - DNA, 16 bp, Artificial Sequence
  synthetic [barcode part1]
tgaatacgaagaccgt

SEQ ID NO: 37193 - DNA, 16 bp, Artificial Sequence
  synthetic [barcode part1]
caggattaactggtcc

SEQ ID NO: 37194 - DNA, 16 bp, Artificial Sequence
  synthetic [barcode part1]
agtacgttgtgcaacc

SEQ ID NO: 37195 - DNA, 16 bp, Artificial Sequence
  synthetic [barcode part1]
gtggcgttcaagattc

SEQ ID NO: 37196 - DNA, 16 bp, Artificial Sequence
  synthetic [barcode part1]
cgtgaacttcactact

SEQ ID NO: 37197 - DNA, 16 bp, Artificial Sequence
  synthetic [barcode part1]
aattactcgtcctcag

SEQ ID NO: 37198 - DNA, 16 bp, Artificial Sequence
  synthetic [barcode part1]
gttaatactgccactc

SEQ ID NO: 37199 - DNA, 16 bp, Artificial Sequence
  synthetic [barcode part1]
cagttccaaggaactc

SEQ ID NO: 37200 - DNA, 16 bp, Artificial Sequence
  synthetic [barcode part1]
tactctgtcgtaggtt

SEQ ID NO: 37201 - DNA, 16 bp, Artificial Sequence
  synthetic [barcode part1]
atcttcgaggcacagt

SEQ ID NO: 37202 - DNA, 16 bp, Artificial Sequence
  synthetic [barcode part1]
cagtccgagactattg

SEQ ID NO: 37203 - DNA, 16 bp, Artificial Sequence
  synthetic [barcode part1]
tccacgcgttaggtct

SEQ ID NO: 37204 - DNA, 16 bp, Artificial Sequence
  synthetic [barcode part1]
cgtgattcggttcctg

SEQ ID NO: 37205 - DNA, 16 bp, Artificial Sequence
  synthetic [barcode part1]
aagaccggagatagtg

SEQ ID NO: 37206 - DNA, 16 bp, Artificial Sequence
  synthetic [barcode part1]
cgacgtgtagtcttcc

SEQ ID NO: 37207 - DNA, 16 bp, Artificial Sequence
  synthetic [barcode part1]
agttctgactcacttg

SEQ ID NO: 37208 - DNA, 16 bp, Artificial Sequence
  synthetic [barcode part1]
aatcggtccgagattc

SEQ ID NO: 37209 - DNA, 16 bp, Artificial Sequence
  synthetic [barcode part1]
gtcacgatacttacct

SEQ ID NO: 37210 - DNA, 16 bp, Artificial Sequence
  synthetic [barcode part1]
cgcacacttaaccaag

SEQ ID NO: 37211 - DNA, 16 bp, Artificial Sequence
  synthetic [barcode part1]
cagattcgcaatagag

SEQ ID NO: 37212 - DNA, 16 bp, Artificial Sequence
  synthetic [barcode part1]
cacagtgaggtcttgt

SEQ ID NO: 37213 - DNA, 16 bp, Artificial Sequence
  synthetic [barcode part1]
tgacctccgatatatc

SEQ ID NO: 37214 - DNA, 16 bp, Artificial Sequence
  synthetic [barcode part1]
attggtacagaggact

SEQ ID NO: 37215 - DNA, 16 bp, Artificial Sequence
  synthetic [barcode part1]
agtgtaacgccttcag

SEQ ID NO: 37216 - DNA, 16 bp, Artificial Sequence
  synthetic [barcode part1]
atatctcgacctgatc

SEQ ID NO: 37217 - DNA, 16 bp, Artificial Sequence
  synthetic [barcode part1]
accgatatcgtgtgac

SEQ ID NO: 37218 - DNA, 16 bp, Artificial Sequence
  synthetic [barcode part1]
gtagttgtgaccgtac

SEQ ID NO: 37219 - DNA, 16 bp, Artificial Sequence
  synthetic [barcode part1]
acgtgacctgaggagt

SEQ ID NO: 37220 - DNA, 16 bp, Artificial Sequence
  synthetic [barcode part1]
tatcacgaactccgag

SEQ ID NO: 37221 - DNA, 16 bp, Artificial Sequence
  synthetic [barcode part1]
cagtggatctaggcag

SEQ ID NO: 37222 - DNA, 16 bp, Artificial Sequence
  synthetic [barcode part1]
ttgacgaagaccactc

SEQ ID NO: 37223 - DNA, 16 bp, Artificial Sequence
  synthetic [barcode part1]
actgtgaggtagatac

SEQ ID NO: 37224 - DNA, 16 bp, Artificial Sequence
  synthetic [barcode part1]
agaagacggcgatagt

SEQ ID NO: 37225 - DNA, 16 bp, Artificial Sequence
  synthetic [barcode part1]
tgtcgcgatatcacag

SEQ ID NO: 37226 - DNA, 16 bp, Artificial Sequence
  synthetic [barcode part1]
tgacggatcactctag

SEQ ID NO: 37227 - DNA, 16 bp, Artificial Sequence
  synthetic [barcode part1]
gccaagactagaagag

SEQ ID NO: 37228 - DNA, 16 bp, Artificial Sequence
  synthetic [barcode part1]
aggtaagatccgcctt

SEQ ID NO: 37229 - DNA, 16 bp, Artificial Sequence
  synthetic [barcode part1]
acacctcctgagtcac

SEQ ID NO: 37230 - DNA, 16 bp, Artificial Sequence
  synthetic [barcode part1]
cgtaggtcctgtcgtt

SEQ ID NO: 37231 - DNA, 16 bp, Artificial Sequence
  synthetic [barcode part1]
agtcgagttcgcagag

SEQ ID NO: 37232 - DNA, 16 bp, Artificial Sequence
  synthetic [barcode part1]
agtctgtgcgaatctg

SEQ ID NO: 37233 - DNA, 16 bp, Artificial Sequence
  synthetic [barcode part1]
gaactctaccgtaacg

SEQ ID NO: 37234 - DNA, 16 bp, Artificial Sequence
  synthetic [barcode part1]
cagactggtcaagtct

SEQ ID NO: 37235 - DNA, 16 bp, Artificial Sequence
  synthetic [barcode part1]
tcgtgaggcctgaatt

SEQ ID NO: 37236 - DNA, 16 bp, Artificial Sequence
  synthetic [barcode part1]
atcgtggttcggaact

SEQ ID NO: 37237 - DNA, 16 bp, Artificial Sequence
  synthetic [barcode part1]
gagttaattctggccg

SEQ ID NO: 37238 - DNA, 16 bp, Artificial Sequence
  synthetic [barcode part1]
ttaaggtcaccgcagt

SEQ ID NO: 37239 - DNA, 16 bp, Artificial Sequence
  synthetic [barcode part1]
agttcctaggacgact

SEQ ID NO: 37240 - DNA, 16 bp, Artificial Sequence
  synthetic [barcode part1]
atacgtgactacgacc

SEQ ID NO: 37241 - DNA, 16 bp, Artificial Sequence
  synthetic [barcode part1]
gagagacagactgaac

SEQ ID NO: 37242 - DNA, 16 bp, Artificial Sequence
  synthetic [barcode part1]
ccttatagatccagtc

SEQ ID NO: 37243 - DNA, 16 bp, Artificial Sequence
  synthetic [barcode part1]
acaagtctacggactc

SEQ ID NO: 37244 - DNA, 16 bp, Artificial Sequence
  synthetic [barcode part1]
aacacctaacagtgag

SEQ ID NO: 37245 - DNA, 16 bp, Artificial Sequence
  synthetic [barcode part1]
aaggataggcaacttc

SEQ ID NO: 37246 - DNA, 16 bp, Artificial Sequence
  synthetic [barcode part1]
gagtaatccggcgtag

SEQ ID NO: 37247 - DNA, 16 bp, Artificial Sequence
  synthetic [barcode part1]
tccgttggtgtgatcc

SEQ ID NO: 37248 - DNA, 16 bp, Artificial Sequence
  synthetic [barcode part1]
agtgacgttgcagacg

SEQ ID NO: 37249 - DNA, 16 bp, Artificial Sequence
  synthetic [barcode part1]
cgtgttcgtaaggatc

SEQ ID NO: 37250 - DNA, 16 bp, Artificial Sequence
  synthetic [barcode part1]
tgtactggacttcttg

SEQ ID NO: 37251 - DNA, 16 bp, Artificial Sequence
  synthetic [barcode part1]
tgagacttcgaccaac

SEQ ID NO: 37252 - DNA, 16 bp, Artificial Sequence
  synthetic [barcode part1]
tacggaggttgagtcg

SEQ ID NO: 37253 - DNA, 16 bp, Artificial Sequence
  synthetic [barcode part1]
aattactcttacgccg

SEQ ID NO: 37254 - DNA, 16 bp, Artificial Sequence
  synthetic [barcode part1]
aaccgacaactgacct

SEQ ID NO: 37255 - DNA, 16 bp, Artificial Sequence
  synthetic [barcode part1]
tatacggacggagtgc

SEQ ID NO: 37256 - DNA, 16 bp, Artificial Sequence
  synthetic [barcode part1]
acgcgaatatcctcag

SEQ ID NO: 37257 - DNA, 16 bp, Artificial Sequence
  synthetic [barcode part1]
cgacaagaatatccag

SEQ ID NO: 37258 - DNA, 16 bp, Artificial Sequence
  synthetic [barcode part1]
gagttaacacacaacg

SEQ ID NO: 37259 - DNA, 16 bp, Artificial Sequence
  synthetic [barcode part1]
accggcgtctaactct

SEQ ID NO: 37260 - DNA, 16 bp, Artificial Sequence
  synthetic [barcode part1]
tgttggaatctggcac

SEQ ID NO: 37261 - DNA, 16 bp, Artificial Sequence
  synthetic [barcode part1]
gattagactcagtccg

SEQ ID NO: 37262 - DNA, 16 bp, Artificial Sequence
  synthetic [barcode part1]
gcaacaggacacactg

SEQ ID NO: 37263 - DNA, 16 bp, Artificial Sequence
  synthetic [barcode part1]
ttgtcgacaacgatcg

SEQ ID NO: 37264 - DNA, 16 bp, Artificial Sequence
  synthetic [barcode part1]
taaccgacgactaacc

SEQ ID NO: 37265 - DNA, 16 bp, Artificial Sequence
  synthetic [barcode part1]
taggttggatctggtc

SEQ ID NO: 37266 - DNA, 16 bp, Artificial Sequence
  synthetic [barcode part1]
tatcctactcaccacc

SEQ ID NO: 37267 - DNA, 16 bp, Artificial Sequence
  synthetic [barcode part1]
acactagtggtagaac

SEQ ID NO: 37268 - DNA, 16 bp, Artificial Sequence
  synthetic [barcode part1]
acgagagtagtgattc

SEQ ID NO: 37269 - DNA, 16 bp, Artificial Sequence
  synthetic [barcode part1]
tcaccaatcttacgtg

SEQ ID NO: 37270 - DNA, 16 bp, Artificial Sequence
  synthetic [barcode part1]
acggatcactgttctt

SEQ ID NO: 37271 - DNA, 16 bp, Artificial Sequence
  synthetic [barcode part1]
tacctatctgcctgtc

SEQ ID NO: 37272 - DNA, 16 bp, Artificial Sequence
  synthetic [barcode part1]
cgaagtgagtggtaag

SEQ ID NO: 37273 - DNA, 16 bp, Artificial Sequence
  synthetic [barcode part1]
acctgaatctgttgtc

SEQ ID NO: 37274 - DNA, 16 bp, Artificial Sequence
  synthetic [barcode part1]
cactcacagtaggtac

SEQ ID NO: 37275 - DNA, 16 bp, Artificial Sequence
  synthetic [barcode part1]
gatcctcctagtatac

SEQ ID NO: 37276 - DNA, 16 bp, Artificial Sequence
  synthetic [barcode part1]
aaggcgtaccggattg

SEQ ID NO: 37277 - DNA, 16 bp, Artificial Sequence
  synthetic [barcode part1]
gcctaatcgcgttctg

SEQ ID NO: 37278 - DNA, 16 bp, Artificial Sequence
  synthetic [barcode part1]
gtctattcactgtgac

SEQ ID NO: 37279 - DNA, 16 bp, Artificial Sequence
  synthetic [barcode part1]
acggatctgtgttggt

SEQ ID NO: 37280 - DNA, 16 bp, Artificial Sequence
  synthetic [barcode part1]
cggaagaaccacacac

SEQ ID NO: 37281 - DNA, 16 bp, Artificial Sequence
  synthetic [barcode part1]
ttctactcacctagag

SEQ ID NO: 37282 - DNA, 16 bp, Artificial Sequence
  synthetic [barcode part1]
taattactgcctcacg

SEQ ID NO: 37283 - DNA, 16 bp, Artificial Sequence
  synthetic [barcode part1]
gcctggatactacctc

SEQ ID NO: 37284 - DNA, 16 bp, Artificial Sequence
  synthetic [barcode part1]
ataagtggtcctagag

SEQ ID NO: 37285 - DNA, 16 bp, Artificial Sequence
  synthetic [barcode part1]
cgaatcggtgtggagt

SEQ ID NO: 37286 - DNA, 16 bp, Artificial Sequence
  synthetic [barcode part1]
gaacgtggaagtacag

SEQ ID NO: 37287 - DNA, 16 bp, Artificial Sequence
  synthetic [barcode part1]
cagttgaatacacgcc

SEQ ID NO: 37288 - DNA, 16 bp, Artificial Sequence
  synthetic [barcode part1]
ttggacagtgagttcc

SEQ ID NO: 37289 - DNA, 16 bp, Artificial Sequence
  synthetic [barcode part1]
tggtgtgcgatcctct

SEQ ID NO: 37290 - DNA, 16 bp, Artificial Sequence
  synthetic [barcode part1]
tacttggaagagtcag

SEQ ID NO: 37291 - DNA, 16 bp, Artificial Sequence
  synthetic [barcode part1]
accgtctgataggatc

SEQ ID NO: 37292 - DNA, 16 bp, Artificial Sequence
  synthetic [barcode part1]
tcttgtaaccgagttc

SEQ ID NO: 37293 - DNA, 16 bp, Artificial Sequence
  synthetic [barcode part1]
ttcctctagagaggac

SEQ ID NO: 37294 - DNA, 16 bp, Artificial Sequence
  synthetic [barcode part1]
atctccacgttaggtt

SEQ ID NO: 37295 - DNA, 16 bp, Artificial Sequence
  synthetic [barcode part1]
caaggaacgcaaccgt

SEQ ID NO: 37296 - DNA, 16 bp, Artificial Sequence
  synthetic [barcode part1]
tcgtcggatactcctg

SEQ ID NO: 37297 - DNA, 16 bp, Artificial Sequence
  synthetic [barcode part1]
caactactgtcctgcg

SEQ ID NO: 37298 - DNA, 16 bp, Artificial Sequence
  synthetic [barcode part1]
aaccgtattctccggc

SEQ ID NO: 37299 - DNA, 16 bp, Artificial Sequence
  synthetic [barcode part1]
tgcgcagttatcgtcc

SEQ ID NO: 37300 - DNA, 16 bp, Artificial Sequence
  synthetic [barcode part1]
aagattgccagacgcg

SEQ ID NO: 37301 - DNA, 16 bp, Artificial Sequence
  synthetic [barcode part1]
ccgaggtcttatccac

SEQ ID NO: 37302 - DNA, 16 bp, Artificial Sequence
  synthetic [barcode part1]
tgtgtcctatccttgc

SEQ ID NO: 37303 - DNA, 16 bp, Artificial Sequence
  synthetic [barcode part1]
tggaccaacacggagt

SEQ ID NO: 37304 - DNA, 16 bp, Artificial Sequence
  synthetic [barcode part1]
cacaaggaccgtcaag

SEQ ID NO: 37305 - DNA, 16 bp, Artificial Sequence
  synthetic [barcode part1]
agttgactgcagtacc

SEQ ID NO: 37306 - DNA, 16 bp, Artificial Sequence
  synthetic [barcode part1]
gtagttaggtcttcct

SEQ ID NO: 37307 - DNA, 16 bp, Artificial Sequence
  synthetic [barcode part1]
ttctacgcctctgtgt

SEQ ID NO: 37308 - DNA, 16 bp, Artificial Sequence
  synthetic [barcode part1]
tctccttcggtattgc

SEQ ID NO: 37309 - DNA, 16 bp, Artificial Sequence
  synthetic [barcode part1]
aaggtcgtgcgaatcg

SEQ ID NO: 37310 - DNA, 16 bp, Artificial Sequence
  synthetic [barcode part1]
gagacgtctagattag

SEQ ID NO: 37311 - DNA, 16 bp, Artificial Sequence
  synthetic [barcode part1]
aagaaggtcggagttg

SEQ ID NO: 37312 - DNA, 16 bp, Artificial Sequence
  synthetic [barcode part1]
tgtctgtcgttgcggt

SEQ ID NO: 37313 - DNA, 16 bp, Artificial Sequence
  synthetic [barcode part1]
gtgaggaaccgttgac

SEQ ID NO: 37314 - DNA, 16 bp, Artificial Sequence
  synthetic [barcode part1]
tgtgttgttggtcttg

SEQ ID NO: 37315 - DNA, 16 bp, Artificial Sequence
  synthetic [barcode part1]
acgcgtgaatcaatcc

SEQ ID NO: 37316 - DNA, 16 bp, Artificial Sequence
  synthetic [barcode part1]
gtgcacactgattggt

SEQ ID NO: 37317 - DNA, 16 bp, Artificial Sequence
  synthetic [barcode part1]
gttcaaggacaagatc

SEQ ID NO: 37318 - DNA, 16 bp, Artificial Sequence
  synthetic [barcode part1]
cacagttcgacctctg

SEQ ID NO: 37319 - DNA, 16 bp, Artificial Sequence
  synthetic [barcode part1]
acaaggcctgtcttag

SEQ ID NO: 37320 - DNA, 16 bp, Artificial Sequence
  synthetic [barcode part1]
gcacgattcgactcct

SEQ ID NO: 37321 - DNA, 16 bp, Artificial Sequence
  synthetic [barcode part1]
atacggtcgtggttac

SEQ ID NO: 37322 - DNA, 16 bp, Artificial Sequence
  synthetic [barcode part1]
gatatcgtcagagtcc

SEQ ID NO: 37323 - DNA, 16 bp, Artificial Sequence
  synthetic [barcode part1]
accggataacgacctt

SEQ ID NO: 37324 - DNA, 16 bp, Artificial Sequence
  synthetic [barcode part1]
gagactctcgtccact

SEQ ID NO: 37325 - DNA, 16 bp, Artificial Sequence
  synthetic [barcode part1]
aagtcacacctagtgc

SEQ ID NO: 37326 - DNA, 16 bp, Artificial Sequence
  synthetic [barcode part1]
cctgaatcctagtccg

SEQ ID NO: 37327 - DNA, 16 bp, Artificial Sequence
  synthetic [barcode part1]
ttatcacttgcgagtc

SEQ ID NO: 37328 - DNA, 16 bp, Artificial Sequence
  synthetic [barcode part1]
ttgtctatcgcctacc

SEQ ID NO: 37329 - DNA, 16 bp, Artificial Sequence
  synthetic [barcode part1]
attagactccggcagt

SEQ ID NO: 37330 - DNA, 16 bp, Artificial Sequence
  synthetic [barcode part1]
ttggcagacctagtgt

SEQ ID NO: 37331 - DNA, 16 bp, Artificial Sequence
  synthetic [barcode part1]
taggatacgagttcag

SEQ ID NO: 37332 - DNA, 16 bp, Artificial Sequence
  synthetic [barcode part1]
gtcgagaattgtacag

SEQ ID NO: 37333 - DNA, 16 bp, Artificial Sequence
  synthetic [barcode part1]
tcgacaatcgtcgaac

SEQ ID NO: 37334 - DNA, 16 bp, Artificial Sequence
  synthetic [barcode part1]
cgcaatagtccgtctc

SEQ ID NO: 37335 - DNA, 16 bp, Artificial Sequence
  synthetic [barcode part1]
cgtccttactagattg

SEQ ID NO: 37336 - DNA, 16 bp, Artificial Sequence
  synthetic [barcode part1]
gttagactatcggacc

SEQ ID NO: 37337 - DNA, 16 bp, Artificial Sequence
  synthetic [barcode part1]
tagtggtcctcacgtc

SEQ ID NO: 37338 - DNA, 16 bp, Artificial Sequence
  synthetic [barcode part1]
atctggatccgagtac

SEQ ID NO: 37339 - DNA, 16 bp, Artificial Sequence
  synthetic [barcode part1]
gtctgtaagttacgcg

SEQ ID NO: 37340 - DNA, 16 bp, Artificial Sequence
  synthetic [barcode part1]
gatcacgttgatctct

SEQ ID NO: 37341 - DNA, 16 bp, Artificial Sequence
  synthetic [barcode part1]
tgacacgaacttgcgt

SEQ ID NO: 37342 - DNA, 16 bp, Artificial Sequence
  synthetic [barcode part1]
tgataccaacactgcg

SEQ ID NO: 37343 - DNA, 16 bp, Artificial Sequence
  synthetic [barcode part1]
aagaatccgtggccag

SEQ ID NO: 37344 - DNA, 16 bp, Artificial Sequence
  synthetic [barcode part1]
caccagaagtgactct

SEQ ID NO: 37345 - DNA, 16 bp, Artificial Sequence
  synthetic [barcode part1]
gaattgaccgatctcg

SEQ ID NO: 37346 - DNA, 16 bp, Artificial Sequence
  synthetic [barcode part1]
agacgtgtcctatacg

SEQ ID NO: 37347 - DNA, 16 bp, Artificial Sequence
  synthetic [barcode part1]
aatattcgcggtcacg

SEQ ID NO: 37348 - DNA, 16 bp, Artificial Sequence
  synthetic [barcode part1]
cgacttagtccaacag

SEQ ID NO: 37349 - DNA, 16 bp, Artificial Sequence
  synthetic [barcode part1]
gtgataatcgccactg

SEQ ID NO: 37350 - DNA, 16 bp, Artificial Sequence
  synthetic [barcode part1]
accttgacgacactag

SEQ ID NO: 37351 - DNA, 16 bp, Artificial Sequence
  synthetic [barcode part1]
cctggcagaatataag

SEQ ID NO: 37352 - DNA, 16 bp, Artificial Sequence
  synthetic [barcode part1]
tcggaatcctacttac

SEQ ID NO: 37353 - DNA, 16 bp, Artificial Sequence
  synthetic [barcode part1]
cgcaatagtgagtaac

SEQ ID NO: 37354 - DNA, 16 bp, Artificial Sequence
  synthetic [barcode part1]
actaccacgtacctcg

SEQ ID NO: 37355 - DNA, 16 bp, Artificial Sequence
  synthetic [barcode part1]
ccaggtagtagatcct

SEQ ID NO: 37356 - DNA, 16 bp, Artificial Sequence
  synthetic [barcode part1]
tggattctctactgtg

SEQ ID NO: 37357 - DNA, 16 bp, Artificial Sequence
  synthetic [barcode part1]
agtgactctagtggtc

SEQ ID NO: 37358 - DNA, 16 bp, Artificial Sequence
  synthetic [barcode part1]
actgcgccaacttctg

SEQ ID NO: 37359 - DNA, 16 bp, Artificial Sequence
  synthetic [barcode part1]
tgtatcttcgcgtctc

SEQ ID NO: 37360 - DNA, 16 bp, Artificial Sequence
  synthetic [barcode part1]
actggagttctctgag

SEQ ID NO: 37361 - DNA, 16 bp, Artificial Sequence
  synthetic [barcode part1]
tcaggagtataggttg

SEQ ID NO: 37362 - DNA, 16 bp, Artificial Sequence
  synthetic [barcode part1]
tgccgaattacgtctt

SEQ ID NO: 37363 - DNA, 16 bp, Artificial Sequence
  synthetic [barcode part1]
gtcacaacaggtaggc

SEQ ID NO: 37364 - DNA, 16 bp, Artificial Sequence
  synthetic [barcode part1]
aaccagttgactggtc

SEQ ID NO: 37365 - DNA, 16 bp, Artificial Sequence
  synthetic [barcode part1]
tgaacaacgttcgtcg

SEQ ID NO: 37366 - DNA, 16 bp, Artificial Sequence
  synthetic [barcode part1]
ttgtaatcggccaacg

SEQ ID NO: 37367 - DNA, 16 bp, Artificial Sequence
  synthetic [barcode part1]
atacaccacgatcacg

SEQ ID NO: 37368 - DNA, 16 bp, Artificial Sequence
  synthetic [barcode part1]
tgtaggcagtagaact

SEQ ID NO: 37369 - DNA, 16 bp, Artificial Sequence
  synthetic [barcode part1]
gtgtggaggtaatccg

SEQ ID NO: 37370 - DNA, 16 bp, Artificial Sequence
  synthetic [barcode part1]
ttgttggcaacggttg

SEQ ID NO: 37371 - DNA, 16 bp, Artificial Sequence
  synthetic [barcode part1]
gtctgttctcggaatt

SEQ ID NO: 37372 - DNA, 16 bp, Artificial Sequence
  synthetic [barcode part1]
gtccaccttacctact

SEQ ID NO: 37373 - DNA, 16 bp, Artificial Sequence
  synthetic [barcode part1]
gaagttacacggaccg

SEQ ID NO: 37374 - DNA, 16 bp, Artificial Sequence
  synthetic [barcode part1]
gttcctggagtacaac

SEQ ID NO: 37375 - DNA, 16 bp, Artificial Sequence
  synthetic [barcode part1]
tcgacctcgttctatc

SEQ ID NO: 37376 - DNA, 16 bp, Artificial Sequence
  synthetic [barcode part1]
tgtgaggtgacaaccg

SEQ ID NO: 37377 - DNA, 16 bp, Artificial Sequence
  synthetic [barcode part1]
acgttagtgcgtcaac

SEQ ID NO: 37378 - DNA, 16 bp, Artificial Sequence
  synthetic [barcode part1]
gtcgttagaaggtgcg

SEQ ID NO: 37379 - DNA, 16 bp, Artificial Sequence
  synthetic [barcode part1]
accaggtacaggaatt

SEQ ID NO: 37380 - DNA, 16 bp, Artificial Sequence
  synthetic [barcode part1]
gcacgacttgacttcc

SEQ ID NO: 37381 - DNA, 16 bp, Artificial Sequence
  synthetic [barcode part1]
attacgcactactctg

SEQ ID NO: 37382 - DNA, 16 bp, Artificial Sequence
  synthetic [barcode part1]
atagtgcggtcagttc

SEQ ID NO: 37383 - DNA, 16 bp, Artificial Sequence
  synthetic [barcode part1]
cggagtaacaaccacg

SEQ ID NO: 37384 - DNA, 16 bp, Artificial Sequence
  synthetic [barcode part1]
atactaaccagacgcc

SEQ ID NO: 37385 - DNA, 16 bp, Artificial Sequence
  synthetic [barcode part1]
gcagattctaacgtgc

SEQ ID NO: 37386 - DNA, 16 bp, Artificial Sequence
  synthetic [barcode part1]
ttgccaactgacagtg

SEQ ID NO: 37387 - DNA, 16 bp, Artificial Sequence
  synthetic [barcode part1]
atctcttcacagtcag

SEQ ID NO: 37388 - DNA, 16 bp, Artificial Sequence
  synthetic [barcode part1]
cgaacgttgtggactt

SEQ ID NO: 37389 - DNA, 16 bp, Artificial Sequence
  synthetic [barcode part1]
ttagtcgcggttagtg

SEQ ID NO: 37390 - DNA, 16 bp, Artificial Sequence
  synthetic [barcode part1]
gtatccactgtcttag

SEQ ID NO: 37391 - DNA, 16 bp, Artificial Sequence
  synthetic [barcode part1]
agactcacactccacc

SEQ ID NO: 37392 - DNA, 16 bp, Artificial Sequence
  synthetic [barcode part1]
acgcacgattgtagtc

SEQ ID NO: 37393 - DNA, 16 bp, Artificial Sequence
  synthetic [barcode part1]
actgttggtacctccg

SEQ ID NO: 37394 - DNA, 16 bp, Artificial Sequence
  synthetic [barcode part1]
agtcgagtctgcgaag

SEQ ID NO: 37395 - DNA, 16 bp, Artificial Sequence
  synthetic [barcode part1]
gtgtgtagaaggagac

SEQ ID NO: 37396 - DNA, 16 bp, Artificial Sequence
  synthetic [barcode part1]
acacgacgattctctt

SEQ ID NO: 37397 - DNA, 16 bp, Artificial Sequence
  synthetic [barcode part1]
acgtcggaacttacac

SEQ ID NO: 37398 - DNA, 16 bp, Artificial Sequence
  synthetic [barcode part1]
ttaggtcagagtgtag

SEQ ID NO: 37399 - DNA, 16 bp, Artificial Sequence
  synthetic [barcode part1]
gcagttagattgagac

SEQ ID NO: 37400 - DNA, 16 bp, Artificial Sequence
  synthetic [barcode part1]
ttcagtgcctgtaccg

SEQ ID NO: 37401 - DNA, 16 bp, Artificial Sequence
  synthetic [barcode part1]
acctaggaggttcgtt

SEQ ID NO: 37402 - DNA, 16 bp, Artificial Sequence
  synthetic [barcode part1]
cctcggatattcgtcg

SEQ ID NO: 37403 - DNA, 16 bp, Artificial Sequence
  synthetic [barcode part1]
acaggacgtctgtgag

SEQ ID NO: 37404 - DNA, 16 bp, Artificial Sequence
  synthetic [barcode part1]
aagactcgcagtatcc

SEQ ID NO: 37405 - DNA, 16 bp, Artificial Sequence
  synthetic [barcode part1]
tcttgtgccaacgatt

SEQ ID NO: 37406 - DNA, 16 bp, Artificial Sequence
  synthetic [barcode part1]
gttgacacgtcctacc

SEQ ID NO: 37407 - DNA, 16 bp, Artificial Sequence
  synthetic [barcode part1]
gccacgtagaacagtg

SEQ ID NO: 37408 - DNA, 16 bp, Artificial Sequence
  synthetic [barcode part1]
acgccaagtcagaggt

SEQ ID NO: 37409 - DNA, 16 bp, Artificial Sequence
  synthetic [barcode part1]
cactgtataactggcg

SEQ ID NO: 37410 - DNA, 16 bp, Artificial Sequence
  synthetic [barcode part1]
acgatcgccaactcct

SEQ ID NO: 37411 - DNA, 16 bp, Artificial Sequence
  synthetic [barcode part1]
cgtaacagataggcgc

SEQ ID NO: 37412 - DNA, 16 bp, Artificial Sequence
  synthetic [barcode part1]
acttcgcacaggatac

SEQ ID NO: 37413 - DNA, 16 bp, Artificial Sequence
  synthetic [barcode part1]
cggtgcgtgatagagt

SEQ ID NO: 37414 - DNA, 16 bp, Artificial Sequence
  synthetic [barcode part1]
gccacttacttgcgac

SEQ ID NO: 37415 - DNA, 16 bp, Artificial Sequence
  synthetic [barcode part1]
atctactgcctgttcc

SEQ ID NO: 37416 - DNA, 16 bp, Artificial Sequence
  synthetic [barcode part1]
actcgccacaacacct

SEQ ID NO: 37417 - DNA, 16 bp, Artificial Sequence
  synthetic [barcode part1]
gacacaccaacacact

SEQ ID NO: 37418 - DNA, 16 bp, Artificial Sequence
  synthetic [barcode part1]
gtatcgatcgacacac

SEQ ID NO: 37419 - DNA, 16 bp, Artificial Sequence
  synthetic [barcode part1]
gactgtgcacagttgt

SEQ ID NO: 37420 - DNA, 16 bp, Artificial Sequence
  synthetic [barcode part1]
cgcaaccgatctatag

SEQ ID NO: 37421 - DNA, 16 bp, Artificial Sequence
  synthetic [barcode part1]
cgtgtattctccttcg

SEQ ID NO: 37422 - DNA, 16 bp, Artificial Sequence
  synthetic [barcode part1]
gaactgtgacgtaggc

SEQ ID NO: 37423 - DNA, 16 bp, Artificial Sequence
  synthetic [barcode part1]
tgtattccttaacggc

SEQ ID NO: 37424 - DNA, 16 bp, Artificial Sequence
  synthetic [barcode part1]
gccaacctaattggtg

SEQ ID NO: 37425 - DNA, 16 bp, Artificial Sequence
  synthetic [barcode part1]
accaggaagttgagag

SEQ ID NO: 37426 - DNA, 16 bp, Artificial Sequence
  synthetic [barcode part1]
gtgattcctgcgttcg

SEQ ID NO: 37427 - DNA, 16 bp, Artificial Sequence
  synthetic [barcode part1]
aggaattatcggcgcg

SEQ ID NO: 37428 - DNA, 16 bp, Artificial Sequence
  synthetic [barcode part1]
cgaactgtggtgactt

SEQ ID NO: 37429 - DNA, 16 bp, Artificial Sequence
  synthetic [barcode part1]
tataaggtgcggagag

SEQ ID NO: 37430 - DNA, 16 bp, Artificial Sequence
  synthetic [barcode part1]
gtggatcacacctagt

SEQ ID NO: 37431 - DNA, 16 bp, Artificial Sequence
  synthetic [barcode part1]
acaacgcgaccttagt

SEQ ID NO: 37432 - DNA, 16 bp, Artificial Sequence
  synthetic [barcode part1]
cctctgatcagttctc

SEQ ID NO: 37433 - DNA, 16 bp, Artificial Sequence
  synthetic [barcode part1]
tacagtctcttcaacg

SEQ ID NO: 37434 - DNA, 16 bp, Artificial Sequence
  synthetic [barcode part1]
gatagttcacgtcctt

SEQ ID NO: 37435 - DNA, 16 bp, Artificial Sequence
  synthetic [barcode part1]
acagtacagtctcgac

SEQ ID NO: 37436 - DNA, 16 bp, Artificial Sequence
  synthetic [barcode part1]
agaccttggtctcaag

SEQ ID NO: 37437 - DNA, 16 bp, Artificial Sequence
  synthetic [barcode part1]
ttggaattacctgcct

SEQ ID NO: 37438 - DNA, 16 bp, Artificial Sequence
  synthetic [barcode part1]
tcttgtaccaggtcgc

SEQ ID NO: 37439 - DNA, 16 bp, Artificial Sequence
  synthetic [barcode part1]
tgagactgtcaactgc

SEQ ID NO: 37440 - DNA, 16 bp, Artificial Sequence
  synthetic [barcode part1]
ccttccagatatactg

SEQ ID NO: 37441 - DNA, 16 bp, Artificial Sequence
  synthetic [barcode part1]
caccgaaggatcactt

SEQ ID NO: 37442 - DNA, 16 bp, Artificial Sequence
  synthetic [barcode part1]
gacacacacacgttgt

SEQ ID NO: 37443 - DNA, 16 bp, Artificial Sequence
  synthetic [barcode part1]
ccgacttaacggtaac

SEQ ID NO: 37444 - DNA, 16 bp, Artificial Sequence
  synthetic [barcode part1]
tagagtacggaagacg

SEQ ID NO: 37445 - DNA, 16 bp, Artificial Sequence
  synthetic [barcode part1]
cgtggacagtacttac

SEQ ID NO: 37446 - DNA, 16 bp, Artificial Sequence
  synthetic [barcode part1]
accagagagaggattg

SEQ ID NO: 37447 - DNA, 16 bp, Artificial Sequence
  synthetic [barcode part1]
acggagactggtgatc

SEQ ID NO: 37448 - DNA, 16 bp, Artificial Sequence
  synthetic [barcode part1]
cgaacgcaactgtatc

SEQ ID NO: 37449 - DNA, 16 bp, Artificial Sequence
  synthetic [barcode part1]
cgtggtaatctgttct

SEQ ID NO: 37450 - DNA, 16 bp, Artificial Sequence
  synthetic [barcode part1]
caggtgactataacag

SEQ ID NO: 37451 - DNA, 16 bp, Artificial Sequence
  synthetic [barcode part1]
tatcggtatcaacgcg

SEQ ID NO: 37452 - DNA, 16 bp, Artificial Sequence
  synthetic [barcode part1]
gtggaactgttgtctg

SEQ ID NO: 37453 - DNA, 16 bp, Artificial Sequence
  synthetic [barcode part1]
tcggtatcggttacag

SEQ ID NO: 37454 - DNA, 16 bp, Artificial Sequence
  synthetic [barcode part1]
tgtgttctaccgaact

SEQ ID NO: 37455 - DNA, 16 bp, Artificial Sequence
  synthetic [barcode part1]
cctccaagtgtatcgc

SEQ ID NO: 37456 - DNA, 16 bp, Artificial Sequence
  synthetic [barcode part1]
ttctactggtactcag

SEQ ID NO: 37457 - DNA, 16 bp, Artificial Sequence
  synthetic [barcode part1]
cgttcgttaagatctc

SEQ ID NO: 37458 - DNA, 16 bp, Artificial Sequence
  synthetic [barcode part1]
gattgatcgaccgact

SEQ ID NO: 37459 - DNA, 16 bp, Artificial Sequence
  synthetic [barcode part1]
gatccaaggttatcgc

SEQ ID NO: 37460 - DNA, 16 bp, Artificial Sequence
  synthetic [barcode part1]
tccagtcacactgacc

SEQ ID NO: 37461 - DNA, 16 bp, Artificial Sequence
  synthetic [barcode part1]
tccaaggcgactagtt

SEQ ID NO: 37462 - DNA, 16 bp, Artificial Sequence
  synthetic [barcode part1]
tcttcctctctcttcc

SEQ ID NO: 37463 - DNA, 16 bp, Artificial Sequence
  synthetic [barcode part1]
gttgcggtgttcactc

SEQ ID NO: 37464 - DNA, 16 bp, Artificial Sequence
  synthetic [barcode part1]
cagttgagaaggagac

SEQ ID NO: 37465 - DNA, 16 bp, Artificial Sequence
  synthetic [barcode part1]
tctagagagagtctcc

SEQ ID NO: 37466 - DNA, 16 bp, Artificial Sequence
  synthetic [barcode part1]
gaattcggtctcctgc

SEQ ID NO: 37467 - DNA, 16 bp, Artificial Sequence
  synthetic [barcode part1]
actctcgcaagttatc

SEQ ID NO: 37468 - DNA, 16 bp, Artificial Sequence
  synthetic [barcode part1]
gtctaccgatactgcc

SEQ ID NO: 37469 - DNA, 16 bp, Artificial Sequence
  synthetic [barcode part1]
ataacactgacgccgt

SEQ ID NO: 37470 - DNA, 16 bp, Artificial Sequence
  synthetic [barcode part1]
gtgatcgtggttacgt

SEQ ID NO: 37471 - DNA, 16 bp, Artificial Sequence
  synthetic [barcode part1]
caagacgtgaagagtg

SEQ ID NO: 37472 - DNA, 16 bp, Artificial Sequence
  synthetic [barcode part1]
gagtgttctgcaagtc

SEQ ID NO: 37473 - DNA, 16 bp, Artificial Sequence
  synthetic [barcode part1]
cagttaacctcggagt

SEQ ID NO: 37474 - DNA, 16 bp, Artificial Sequence
  synthetic [barcode part1]
gcagtgcgtatatacc

SEQ ID NO: 37475 - DNA, 16 bp, Artificial Sequence
  synthetic [barcode part1]
gtagaaggtcgaactt

SEQ ID NO: 37476 - DNA, 16 bp, Artificial Sequence
  synthetic [barcode part1]
atcgcggtatctgtcc

SEQ ID NO: 37477 - DNA, 16 bp, Artificial Sequence
  synthetic [barcode part1]
tgtcagacagagacgc

SEQ ID NO: 37478 - DNA, 16 bp, Artificial Sequence
  synthetic [barcode part1]
cgcagtacttgcctgt

SEQ ID NO: 37479 - DNA, 16 bp, Artificial Sequence
  synthetic [barcode part1]
agagtctcaggacttc

SEQ ID NO: 37480 - DNA, 16 bp, Artificial Sequence
  synthetic [barcode part1]
caacttgtgaactgcg

SEQ ID NO: 37481 - DNA, 16 bp, Artificial Sequence
  synthetic [barcode part1]
gcggattccttcggtt

SEQ ID NO: 37482 - DNA, 16 bp, Artificial Sequence
  synthetic [barcode part1]
ttcagtcgccgacact

SEQ ID NO: 37483 - DNA, 16 bp, Artificial Sequence
  synthetic [barcode part1]
acaacacaagacctcc

SEQ ID NO: 37484 - DNA, 16 bp, Artificial Sequence
  synthetic [barcode part1]
atcgtaggtccactcc

SEQ ID NO: 37485 - DNA, 16 bp, Artificial Sequence
  synthetic [barcode part1]
tgcctaatctccgacg

SEQ ID NO: 37486 - DNA, 16 bp, Artificial Sequence
  synthetic [barcode part1]
cgtccgacttctagtg

SEQ ID NO: 37487 - DNA, 16 bp, Artificial Sequence
  synthetic [barcode part1]
gagtgagatctcaggc

SEQ ID NO: 37488 - DNA, 16 bp, Artificial Sequence
  synthetic [barcode part1]
gatacgtggccaagac

SEQ ID NO: 37489 - DNA, 16 bp, Artificial Sequence
  synthetic [barcode part1]
aaggaactatcggtgt

SEQ ID NO: 37490 - DNA, 16 bp, Artificial Sequence
  synthetic [barcode part1]
caaggtcactacgact

SEQ ID NO: 37491 - DNA, 16 bp, Artificial Sequence
  synthetic [barcode part1]
cacggacgtaacagac

SEQ ID NO: 37492 - DNA, 16 bp, Artificial Sequence
  synthetic [barcode part1]
gttaccagttgccaag

SEQ ID NO: 37493 - DNA, 16 bp, Artificial Sequence
  synthetic [barcode part1]
caatacagagacgact

SEQ ID NO: 37494 - DNA, 16 bp, Artificial Sequence
  synthetic [barcode part1]
gaggactcaacacgtg

SEQ ID NO: 37495 - DNA, 16 bp, Artificial Sequence
  synthetic [barcode part1]
aacttgcagtagaacg

SEQ ID NO: 37496 - DNA, 16 bp, Artificial Sequence
  synthetic [barcode part1]
tctcaagacgagtaag

SEQ ID NO: 37497 - DNA, 16 bp, Artificial Sequence
  synthetic [barcode part1]
actggaggtgtgtcag

SEQ ID NO: 37498 - DNA, 16 bp, Artificial Sequence
  synthetic [barcode part1]
ttcgactcggcgtgtt

SEQ ID NO: 37499 - DNA, 16 bp, Artificial Sequence
  synthetic [barcode part1]
agtctccgatcgtacc

SEQ ID NO: 37500 - DNA, 16 bp, Artificial Sequence
  synthetic [barcode part1]
aggtacgttaacaacg

SEQ ID NO: 37501 - DNA, 16 bp, Artificial Sequence
  synthetic [barcode part1]
ccacctggaactctgt

SEQ ID NO: 37502 - DNA, 16 bp, Artificial Sequence
  synthetic [barcode part1]
tgagttgtggtgactc

SEQ ID NO: 37503 - DNA, 16 bp, Artificial Sequence
  synthetic [barcode part1]
tgtctgagactcacag

SEQ ID NO: 37504 - DNA, 16 bp, Artificial Sequence
  synthetic [barcode part1]
taggttatccttgcgt

SEQ ID NO: 37505 - DNA, 16 bp, Artificial Sequence
  synthetic [barcode part1]
cactacaccgatcaag

SEQ ID NO: 37506 - DNA, 16 bp, Artificial Sequence
  synthetic [barcode part1]
tcctcgaacgttaatc

SEQ ID NO: 37507 - DNA, 16 bp, Artificial Sequence
  synthetic [barcode part1]
acttcgtgcagttgtt

SEQ ID NO: 37508 - DNA, 16 bp, Artificial Sequence
  synthetic [barcode part1]
acggcaatactggcag

SEQ ID NO: 37509 - DNA, 16 bp, Artificial Sequence
  synthetic [barcode part1]
tcacgagtagactcgt

SEQ ID NO: 37510 - DNA, 16 bp, Artificial Sequence
  synthetic [barcode part1]
tcctgaagtggacgag

SEQ ID NO: 37511 - DNA, 16 bp, Artificial Sequence
  synthetic [barcode part1]
tgcctcagtggattcc

SEQ ID NO: 37512 - DNA, 16 bp, Artificial Sequence
  synthetic [barcode part1]
gtgtcttgacttggtt

SEQ ID NO: 37513 - DNA, 16 bp, Artificial Sequence
  synthetic [barcode part1]
acctagatagagtgac

SEQ ID NO: 37514 - DNA, 16 bp, Artificial Sequence
  synthetic [barcode part1]
gagtgcacacaagaag

SEQ ID NO: 37515 - DNA, 16 bp, Artificial Sequence
  synthetic [barcode part1]
cgtatcaacgcgttag

SEQ ID NO: 37516 - DNA, 16 bp, Artificial Sequence
  synthetic [barcode part1]
atctgaactgttccgt

SEQ ID NO: 37517 - DNA, 16 bp, Artificial Sequence
  synthetic [barcode part1]
tacgtacgtgtacacg

SEQ ID NO: 37518 - DNA, 16 bp, Artificial Sequence
  synthetic [barcode part1]
tgaccaagttgcagtc

SEQ ID NO: 37519 - DNA, 16 bp, Artificial Sequence
  synthetic [barcode part1]
acggattgttatcctc

SEQ ID NO: 37520 - DNA, 16 bp, Artificial Sequence
  synthetic [barcode part1]
aggcgaaggataagtc

SEQ ID NO: 37521 - DNA, 16 bp, Artificial Sequence
  synthetic [barcode part1]
tcgtgaacactccacc

SEQ ID NO: 37522 - DNA, 16 bp, Artificial Sequence
  synthetic [barcode part1]
tctgtgagagttcgtg

SEQ ID NO: 37523 - DNA, 16 bp, Artificial Sequence
  synthetic [barcode part1]
tggcagtatcgagtct

SEQ ID NO: 37524 - DNA, 16 bp, Artificial Sequence
  synthetic [barcode part1]
gttgaatcggaccact

SEQ ID NO: 37525 - DNA, 16 bp, Artificial Sequence
  synthetic [barcode part1]
agacctgcctggtctt

SEQ ID NO: 37526 - DNA, 16 bp, Artificial Sequence
  synthetic [barcode part1]
gacggtcttgaatcac

SEQ ID NO: 37527 - DNA, 16 bp, Artificial Sequence
  synthetic [barcode part1]
cgaagacgacaacctg

SEQ ID NO: 37528 - DNA, 16 bp, Artificial Sequence
  synthetic [barcode part1]
tgacagtgaggacgtc

SEQ ID NO: 37529 - DNA, 16 bp, Artificial Sequence
  synthetic [barcode part1]
tggcaattcaacgacc

SEQ ID NO: 37530 - DNA, 16 bp, Artificial Sequence
  synthetic [barcode part1]
taacgtgacgcaactc

SEQ ID NO: 37531 - DNA, 16 bp, Artificial Sequence
  synthetic [barcode part1]
agactcttctcttccg

SEQ ID NO: 37532 - DNA, 16 bp, Artificial Sequence
  synthetic [barcode part1]
acgagtctgtggactt

SEQ ID NO: 37533 - DNA, 16 bp, Artificial Sequence
  synthetic [barcode part1]
gtgaaggtgtacttcc

SEQ ID NO: 37534 - DNA, 16 bp, Artificial Sequence
  synthetic [barcode part1]
agttaacgtcgaccgt

SEQ ID NO: 37535 - DNA, 16 bp, Artificial Sequence
  synthetic [barcode part1]
tgcaacactcaggatc

SEQ ID NO: 37536 - DNA, 16 bp, Artificial Sequence
  synthetic [barcode part1]
ttgtgtgacgtcagtg

SEQ ID NO: 37537 - DNA, 16 bp, Artificial Sequence
  synthetic [barcode part1]
gattacgtgtgaccac

SEQ ID NO: 37538 - DNA, 16 bp, Artificial Sequence
  synthetic [barcode part1]
aataaccgtacctcct

SEQ ID NO: 37539 - DNA, 16 bp, Artificial Sequence
  synthetic [barcode part1]
acaccttggtccggtt

SEQ ID NO: 37540 - DNA, 16 bp, Artificial Sequence
  synthetic [barcode part1]
gtccttgcggattgtc

SEQ ID NO: 37541 - DNA, 16 bp, Artificial Sequence
  synthetic [barcode part1]
tgcagacggatctact

SEQ ID NO: 37542 - DNA, 16 bp, Artificial Sequence
  synthetic [barcode part1]
gcgtggtattacacac

SEQ ID NO: 37543 - DNA, 16 bp, Artificial Sequence
  synthetic [barcode part1]
acgcctcgttggactt

SEQ ID NO: 37544 - DNA, 16 bp, Artificial Sequence
  synthetic [barcode part1]
acttgaagacgaggtt

SEQ ID NO: 37545 - DNA, 16 bp, Artificial Sequence
  synthetic [barcode part1]
acacgcctcactactg

SEQ ID NO: 37546 - DNA, 16 bp, Artificial Sequence
  synthetic [barcode part1]
taattgacacgtgcgc

SEQ ID NO: 37547 - DNA, 16 bp, Artificial Sequence
  synthetic [barcode part1]
tctctgataatcgcgt

SEQ ID NO: 37548 - DNA, 16 bp, Artificial Sequence
  synthetic [barcode part1]
gccttatcgagagact

SEQ ID NO: 37549 - DNA, 16 bp, Artificial Sequence
  synthetic [barcode part1]
cgtcttatcgcaagtt

SEQ ID NO: 37550 - DNA, 16 bp, Artificial Sequence
  synthetic [barcode part1]
gtaagtccgtatcgac

SEQ ID NO: 37551 - DNA, 16 bp, Artificial Sequence
  synthetic [barcode part1]
actagtaggtggcggt

SEQ ID NO: 37552 - DNA, 16 bp, Artificial Sequence
  synthetic [barcode part1]
gaccgtgagagtcaac

SEQ ID NO: 37553 - DNA, 16 bp, Artificial Sequence
  synthetic [barcode part1]
ttgaccaccaatcgag

SEQ ID NO: 37554 - DNA, 16 bp, Artificial Sequence
  synthetic [barcode part1]
gtaactgcgatacacc

SEQ ID NO: 37555 - DNA, 16 bp, Artificial Sequence
  synthetic [barcode part1]
gcaataactcgactcg

SEQ ID NO: 37556 - DNA, 16 bp, Artificial Sequence
  synthetic [barcode part1]
aacaccggtcgtagtt

SEQ ID NO: 37557 - DNA, 16 bp, Artificial Sequence
  synthetic [barcode part1]
tgatacgtgcaggttc

SEQ ID NO: 37558 - DNA, 16 bp, Artificial Sequence
  synthetic [barcode part1]
tcagactggaggtgtg

SEQ ID NO: 37559 - DNA, 16 bp, Artificial Sequence
  synthetic [barcode part1]
aataccgttccggaac

SEQ ID NO: 37560 - DNA, 16 bp, Artificial Sequence
  synthetic [barcode part1]
cgcgaatctgtgaact

SEQ ID NO: 37561 - DNA, 16 bp, Artificial Sequence
  synthetic [barcode part1]
tggaacctgacactgt

SEQ ID NO: 37562 - DNA, 16 bp, Artificial Sequence
  synthetic [barcode part1]
agttgaccgatatcgc

SEQ ID NO: 37563 - DNA, 16 bp, Artificial Sequence
  synthetic [barcode part1]
cacgccactctgattg

SEQ ID NO: 37564 - DNA, 16 bp, Artificial Sequence
  synthetic [barcode part1]
aggtacctcacagact

SEQ ID NO: 37565 - DNA, 16 bp, Artificial Sequence
  synthetic [barcode part1]
tccgtattggcaactt

SEQ ID NO: 37566 - DNA, 16 bp, Artificial Sequence
  synthetic [barcode part1]
caggaactatcaagtg

SEQ ID NO: 37567 - DNA, 16 bp, Artificial Sequence
  synthetic [barcode part1]
tctccgtcttagtaag

SEQ ID NO: 37568 - DNA, 16 bp, Artificial Sequence
  synthetic [barcode part1]
tagtggtgtacgaggc

SEQ ID NO: 37569 - DNA, 16 bp, Artificial Sequence
  synthetic [barcode part1]
atatagtcgaccacgc

SEQ ID NO: 37570 - DNA, 16 bp, Artificial Sequence
  synthetic [barcode part1]
aacggtcactatcggt

SEQ ID NO: 37571 - DNA, 16 bp, Artificial Sequence
  synthetic [barcode part1]
acgtggatatcaggcg

SEQ ID NO: 37572 - DNA, 16 bp, Artificial Sequence
  synthetic [barcode part1]
gcgaagtgtggattcg

SEQ ID NO: 37573 - DNA, 16 bp, Artificial Sequence
  synthetic [barcode part1]
ccggactagaagtacg

SEQ ID NO: 37574 - DNA, 16 bp, Artificial Sequence
  synthetic [barcode part1]
atacgcactggtcaac

SEQ ID NO: 37575 - DNA, 16 bp, Artificial Sequence
  synthetic [barcode part1]
atcgcaacaagtagac

SEQ ID NO: 37576 - DNA, 16 bp, Artificial Sequence
  synthetic [barcode part1]
gcgttccactatcggt

SEQ ID NO: 37577 - DNA, 16 bp, Artificial Sequence
  synthetic [barcode part1]
atactggacgcagttc

SEQ ID NO: 37578 - DNA, 16 bp, Artificial Sequence
  synthetic [barcode part1]
tgatcgacgatactgc

SEQ ID NO: 37579 - DNA, 16 bp, Artificial Sequence
  synthetic [barcode part1]
ccgtaattgtgtgcag

SEQ ID NO: 37580 - DNA, 16 bp, Artificial Sequence
  synthetic [barcode part1]
caaggaggtaccagtc

SEQ ID NO: 37581 - DNA, 16 bp, Artificial Sequence
  synthetic [barcode part1]
ttctagtgagacggtc

SEQ ID NO: 37582 - DNA, 16 bp, Artificial Sequence
  synthetic [barcode part1]
aacggaacgacgaagt

SEQ ID NO: 37583 - DNA, 16 bp, Artificial Sequence
  synthetic [barcode part1]
gatacaacctacaccg

SEQ ID NO: 37584 - DNA, 16 bp, Artificial Sequence
  synthetic [barcode part1]
aagtgcctctatcact

SEQ ID NO: 37585 - DNA, 16 bp, Artificial Sequence
  synthetic [barcode part1]
aacagttcgacggtct

SEQ ID NO: 37586 - DNA, 16 bp, Artificial Sequence
  synthetic [barcode part1]
cgacctcaccagtact

SEQ ID NO: 37587 - DNA, 16 bp, Artificial Sequence
  synthetic [barcode part1]
cacctgtgttcacttc

SEQ ID NO: 37588 - DNA, 16 bp, Artificial Sequence
  synthetic [barcode part1]
tcgatctccaccactt

SEQ ID NO: 37589 - DNA, 16 bp, Artificial Sequence
  synthetic [barcode part1]
aggtcgataatcgtag

SEQ ID NO: 37590 - DNA, 16 bp, Artificial Sequence
  synthetic [barcode part1]
acggtatctctaggac

SEQ ID NO: 37591 - DNA, 16 bp, Artificial Sequence
  synthetic [barcode part1]
agttcctccttcggtt

SEQ ID NO: 37592 - DNA, 16 bp, Artificial Sequence
  synthetic [barcode part1]
ttaactcacaaccacc

SEQ ID NO: 37593 - DNA, 16 bp, Artificial Sequence
  synthetic [barcode part1]
gagatccgataccgtt

SEQ ID NO: 37594 - DNA, 16 bp, Artificial Sequence
  synthetic [barcode part1]
gtctcgccttacgagt

SEQ ID NO: 37595 - DNA, 16 bp, Artificial Sequence
  synthetic [barcode part1]
cgagaccgttatagtc

SEQ ID NO: 37596 - DNA, 16 bp, Artificial Sequence
  synthetic [barcode part1]
aactcaacgcaagagt

SEQ ID NO: 37597 - DNA, 16 bp, Artificial Sequence
  synthetic [barcode part1]
tcgtagagtcttctac

SEQ ID NO: 37598 - DNA, 16 bp, Artificial Sequence
  synthetic [barcode part1]
ttatctgcgccgtgac

SEQ ID NO: 37599 - DNA, 16 bp, Artificial Sequence
  synthetic [barcode part1]
ccttcgtgaattatcg

SEQ ID NO: 37600 - DNA, 16 bp, Artificial Sequence
  synthetic [barcode part1]
tacttaccaccacggc

SEQ ID NO: 37601 - DNA, 16 bp, Artificial Sequence
  synthetic [barcode part1]
atccgtagtgtgactg

SEQ ID NO: 37602 - DNA, 16 bp, Artificial Sequence
  synthetic [barcode part1]
tcaattctccgcaggc

SEQ ID NO: 37603 - DNA, 16 bp, Artificial Sequence
  synthetic [barcode part1]
atacagaacgactcag

SEQ ID NO: 37604 - DNA, 16 bp, Artificial Sequence
  synthetic [barcode part1]
tacaccagactaagag

SEQ ID NO: 37605 - DNA, 16 bp, Artificial Sequence
  synthetic [barcode part1]
gtagtggcaggttcag

SEQ ID NO: 37606 - DNA, 16 bp, Artificial Sequence
  synthetic [barcode part1]
aacacacgaggaattc

SEQ ID NO: 37607 - DNA, 16 bp, Artificial Sequence
  synthetic [barcode part1]
cgcaataggtattgcc

SEQ ID NO: 37608 - DNA, 16 bp, Artificial Sequence
  synthetic [barcode part1]
gattcaggtacaagac

SEQ ID NO: 37609 - DNA, 16 bp, Artificial Sequence
  synthetic [barcode part1]
ccgtagaacctctcgt

SEQ ID NO: 37610 - DNA, 16 bp, Artificial Sequence
  synthetic [barcode part1]
ttagtagaggtgcagt

SEQ ID NO: 37611 - DNA, 16 bp, Artificial Sequence
  synthetic [barcode part1]
ccgttgttgagtattc

SEQ ID NO: 37612 - DNA, 16 bp, Artificial Sequence
  synthetic [barcode part1]
gtgtgtgcgtatacgt

SEQ ID NO: 37613 - DNA, 16 bp, Artificial Sequence
  synthetic [barcode part1]
actctatacgaccgcc

SEQ ID NO: 37614 - DNA, 16 bp, Artificial Sequence
  synthetic [barcode part1]
agtgatcctaggtcac

SEQ ID NO: 37615 - DNA, 16 bp, Artificial Sequence
  synthetic [barcode part1]
tctgtcgttagtgcgc

SEQ ID NO: 37616 - DNA, 16 bp, Artificial Sequence
  synthetic [barcode part1]
agactacggcaatctc

SEQ ID NO: 37617 - DNA, 16 bp, Artificial Sequence
  synthetic [barcode part1]
atccaaggcaatagac

SEQ ID NO: 37618 - DNA, 16 bp, Artificial Sequence
  synthetic [barcode part1]
gagacaggaacttgcc

SEQ ID NO: 37619 - DNA, 16 bp, Artificial Sequence
  synthetic [barcode part1]
gtattctctaggccgc

SEQ ID NO: 37620 - DNA, 16 bp, Artificial Sequence
  synthetic [barcode part1]
tgtgacaaggttccac

SEQ ID NO: 37621 - DNA, 16 bp, Artificial Sequence
  synthetic [barcode part1]
taccgaatcgcgttcc

SEQ ID NO: 37622 - DNA, 16 bp, Artificial Sequence
  synthetic [barcode part1]
actggcaactcggatt

SEQ ID NO: 37623 - DNA, 16 bp, Artificial Sequence
  synthetic [barcode part1]
aaggcagttcgttgtc

SEQ ID NO: 37624 - DNA, 16 bp, Artificial Sequence
  synthetic [barcode part1]
caacacactccactgc

SEQ ID NO: 37625 - DNA, 16 bp, Artificial Sequence
  synthetic [barcode part1]
ttctgttcgaacgttg

SEQ ID NO: 37626 - DNA, 16 bp, Artificial Sequence
  synthetic [barcode part1]
aacagagaatcgcact

SEQ ID NO: 37627 - DNA, 16 bp, Artificial Sequence
  synthetic [barcode part1]
taccgcgacgttatag

SEQ ID NO: 37628 - DNA, 16 bp, Artificial Sequence
  synthetic [barcode part1]
gcctgacttctacgtg

SEQ ID NO: 37629 - DNA, 16 bp, Artificial Sequence
  synthetic [barcode part1]
actagtctcgatcgag

SEQ ID NO: 37630 - DNA, 16 bp, Artificial Sequence
  synthetic [barcode part1]
gaacctaacctaggtc

SEQ ID NO: 37631 - DNA, 16 bp, Artificial Sequence
  synthetic [barcode part1]
atccttagtagaggcc

SEQ ID NO: 37632 - DNA, 16 bp, Artificial Sequence
  synthetic [barcode part1]
tcggattagaggcgtg

SEQ ID NO: 37633 - DNA, 16 bp, Artificial Sequence
  synthetic [barcode part1]
agtcagtaaccgatcc

SEQ ID NO: 37634 - DNA, 16 bp, Artificial Sequence
  synthetic [barcode part1]
tcgcgaatctaatcct

SEQ ID NO: 37635 - DNA, 16 bp, Artificial Sequence
  synthetic [barcode part1]
cggtaacgacctagtt

SEQ ID NO: 37636 - DNA, 16 bp, Artificial Sequence
  synthetic [barcode part1]
acaaggcagatccgtg

SEQ ID NO: 37637 - DNA, 16 bp, Artificial Sequence
  synthetic [barcode part1]
tgttcttatcgtcgag

SEQ ID NO: 37638 - DNA, 16 bp, Artificial Sequence
  synthetic [barcode part1]
agtagtaagatccacg

SEQ ID NO: 37639 - DNA, 16 bp, Artificial Sequence
  synthetic [barcode part1]
gtatccagacgagacg

SEQ ID NO: 37640 - DNA, 16 bp, Artificial Sequence
  synthetic [barcode part1]
actcacaggagtggtg

SEQ ID NO: 37641 - DNA, 16 bp, Artificial Sequence
  synthetic [barcode part1]
cgtgagacggtctaag

SEQ ID NO: 37642 - DNA, 16 bp, Artificial Sequence
  synthetic [barcode part1]
tatacctatccaacgc

SEQ ID NO: 37643 - DNA, 16 bp, Artificial Sequence
  synthetic [barcode part1]
actgatatcaccgtct

SEQ ID NO: 37644 - DNA, 16 bp, Artificial Sequence
  synthetic [barcode part1]
ttccagaggataggcg

SEQ ID NO: 37645 - DNA, 16 bp, Artificial Sequence
  synthetic [barcode part1]
tactgaggcctaacac

SEQ ID NO: 37646 - DNA, 16 bp, Artificial Sequence
  synthetic [barcode part1]
gttaggtaatacggac

SEQ ID NO: 37647 - DNA, 16 bp, Artificial Sequence
  synthetic [barcode part1]
attgcactgcggattg

SEQ ID NO: 37648 - DNA, 16 bp, Artificial Sequence
  synthetic [barcode part1]
tacgtaactgttgcct

SEQ ID NO: 37649 - DNA, 16 bp, Artificial Sequence
  synthetic [barcode part1]
gttaggtgcctctgtc

SEQ ID NO: 37650 - DNA, 16 bp, Artificial Sequence
  synthetic [barcode part1]
tgtcgccacggttact

SEQ ID NO: 37651 - DNA, 16 bp, Artificial Sequence
  synthetic [barcode part1]
tctgaacttactaccg

SEQ ID NO: 37652 - DNA, 16 bp, Artificial Sequence
  synthetic [barcode part1]
aggatcgacacttaag

SEQ ID NO: 37653 - DNA, 16 bp, Artificial Sequence
  synthetic [barcode part1]
ttggaactatccgttc

SEQ ID NO: 37654 - DNA, 16 bp, Artificial Sequence
  synthetic [barcode part1]
gcacgtaatcgcagtt

SEQ ID NO: 37655 - DNA, 16 bp, Artificial Sequence
  synthetic [barcode part1]
tcgcaaggcctagatt

SEQ ID NO: 37656 - DNA, 16 bp, Artificial Sequence
  synthetic [barcode part1]
gtactcagtctgcaag

SEQ ID NO: 37657 - DNA, 16 bp, Artificial Sequence
  synthetic [barcode part1]
cctgacttgactacgc

SEQ ID NO: 37658 - DNA, 16 bp, Artificial Sequence
  synthetic [barcode part1]
gcactcgtctatcgtg

SEQ ID NO: 37659 - DNA, 16 bp, Artificial Sequence
  synthetic [barcode part1]
tagaacagtggccacg

SEQ ID NO: 37660 - DNA, 16 bp, Artificial Sequence
  synthetic [barcode part1]
cctacaagtggatctg

SEQ ID NO: 37661 - DNA, 16 bp, Artificial Sequence
  synthetic [barcode part1]
gccgtaataaggcctt

SEQ ID NO: 37662 - DNA, 16 bp, Artificial Sequence
  synthetic [barcode part1]
gttcaacagaagtacg

SEQ ID NO: 37663 - DNA, 16 bp, Artificial Sequence
  synthetic [barcode part1]
taccgcgttctagaag

SEQ ID NO: 37664 - DNA, 16 bp, Artificial Sequence
  synthetic [barcode part1]
ttatctgtcgttcgcc

SEQ ID NO: 37665 - DNA, 16 bp, Artificial Sequence
  synthetic [barcode part1]
gtgtctcggtcgttac

SEQ ID NO: 37666 - DNA, 16 bp, Artificial Sequence
  synthetic [barcode part1]
agttcttcctcactgc

SEQ ID NO: 37667 - DNA, 16 bp, Artificial Sequence
  synthetic [barcode part1]
aggaagttcgtacagt

SEQ ID NO: 37668 - DNA, 16 bp, Artificial Sequence
  synthetic [barcode part1]
atcacttgtgagttcc

SEQ ID NO: 37669 - DNA, 16 bp, Artificial Sequence
  synthetic [barcode part1]
aatcaattgcgcacgc

SEQ ID NO: 37670 - DNA, 16 bp, Artificial Sequence
  synthetic [barcode part1]
gagaaccaattctccg

SEQ ID NO: 37671 - DNA, 16 bp, Artificial Sequence
  synthetic [barcode part1]
acggcggttgtacaag

SEQ ID NO: 37672 - DNA, 16 bp, Artificial Sequence
  synthetic [barcode part1]
atctacgtgtggatcg

SEQ ID NO: 37673 - DNA, 16 bp, Artificial Sequence
  synthetic [barcode part1]
aatagttcgtggagac

SEQ ID NO: 37674 - DNA, 16 bp, Artificial Sequence
  synthetic [barcode part1]
agttctccgcagacct

SEQ ID NO: 37675 - DNA, 16 bp, Artificial Sequence
  synthetic [barcode part1]
gacacgcgattgagac

SEQ ID NO: 37676 - DNA, 16 bp, Artificial Sequence
  synthetic [barcode part1]
aatcaagtcgcacaag

SEQ ID NO: 37677 - DNA, 16 bp, Artificial Sequence
  synthetic [barcode part1]
gtgcaacctccgactt

SEQ ID NO: 37678 - DNA, 16 bp, Artificial Sequence
  synthetic [barcode part1]
acttactggtatcgtc

SEQ ID NO: 37679 - DNA, 16 bp, Artificial Sequence
  synthetic [barcode part1]
tcagtccacagttatc

SEQ ID NO: 37680 - DNA, 16 bp, Artificial Sequence
  synthetic [barcode part1]
attcaggtcacgaacc

SEQ ID NO: 37681 - DNA, 16 bp, Artificial Sequence
  synthetic [barcode part1]
gactcaatcctgtgcc

SEQ ID NO: 37682 - DNA, 16 bp, Artificial Sequence
  synthetic [barcode part1]
gccgaactatcctcac

SEQ ID NO: 37683 - DNA, 16 bp, Artificial Sequence
  synthetic [barcode part1]
acaacaatcacacgag

SEQ ID NO: 37684 - DNA, 16 bp, Artificial Sequence
  synthetic [barcode part1]
ttgttggtggttcgag

SEQ ID NO: 37685 - DNA, 16 bp, Artificial Sequence
  synthetic [barcode part1]
aaccgcgatataccac

SEQ ID NO: 37686 - DNA, 16 bp, Artificial Sequence
  synthetic [barcode part1]
actattcagacgacgc

SEQ ID NO: 37687 - DNA, 16 bp, Artificial Sequence
  synthetic [barcode part1]
attcggtagaggtgcg

SEQ ID NO: 37688 - DNA, 16 bp, Artificial Sequence
  synthetic [barcode part1]
gattctcgcgtaatct

SEQ ID NO: 37689 - DNA, 16 bp, Artificial Sequence
  synthetic [barcode part1]
ccaacaacacttccgc

SEQ ID NO: 37690 - DNA, 16 bp, Artificial Sequence
  synthetic [barcode part1]
gcaccgattcctgatc

SEQ ID NO: 37691 - DNA, 16 bp, Artificial Sequence
  synthetic [barcode part1]
accaccgaatcgttag

SEQ ID NO: 37692 - DNA, 16 bp, Artificial Sequence
  synthetic [barcode part1]
tatcgttcgaggaacc

SEQ ID NO: 37693 - DNA, 16 bp, Artificial Sequence
  synthetic [barcode part1]
tagattggcactcctt

SEQ ID NO: 37694 - DNA, 16 bp, Artificial Sequence
  synthetic [barcode part1]
gtaggtggataccacg

SEQ ID NO: 37695 - DNA, 16 bp, Artificial Sequence
  synthetic [barcode part1]
tggtgtaaggagttac

SEQ ID NO: 37696 - DNA, 16 bp, Artificial Sequence
  synthetic [barcode part1]
gcctacctattcacct

SEQ ID NO: 37697 - DNA, 16 bp, Artificial Sequence
  synthetic [barcode part1]
ataccttctaagtcgc

SEQ ID NO: 37698 - DNA, 16 bp, Artificial Sequence
  synthetic [barcode part1]
aactgtgacacgttgc

SEQ ID NO: 37699 - DNA, 16 bp, Artificial Sequence
  synthetic [barcode part1]
tccgtctcgagatctg

SEQ ID NO: 37700 - DNA, 16 bp, Artificial Sequence
  synthetic [barcode part1]
gtaacaattcgcagag

SEQ ID NO: 37701 - DNA, 16 bp, Artificial Sequence
  synthetic [barcode part1]
tcgcaaggagttaagt

SEQ ID NO: 37702 - DNA, 16 bp, Artificial Sequence
  synthetic [barcode part1]
gtctgataactgccag

SEQ ID NO: 37703 - DNA, 16 bp, Artificial Sequence
  synthetic [barcode part1]
gcggagaccttatact

SEQ ID NO: 37704 - DNA, 16 bp, Artificial Sequence
  synthetic [barcode part1]
cgttcacggtgttgtc

SEQ ID NO: 37705 - DNA, 16 bp, Artificial Sequence
  synthetic [barcode part1]
taggaatcttggtgag

SEQ ID NO: 37706 - DNA, 16 bp, Artificial Sequence
  synthetic [barcode part1]
gaccgcagagactaac

SEQ ID NO: 37707 - DNA, 16 bp, Artificial Sequence
  synthetic [barcode part1]
attctggaggatctcg

SEQ ID NO: 37708 - DNA, 16 bp, Artificial Sequence
  synthetic [barcode part1]
aaggacgtagagacac

SEQ ID NO: 37709 - DNA, 16 bp, Artificial Sequence
  synthetic [barcode part1]
tactcgagaggcaacg

SEQ ID NO: 37710 - DNA, 16 bp, Artificial Sequence
  synthetic [barcode part1]
cgtcgagtaagaacgc

SEQ ID NO: 37711 - DNA, 16 bp, Artificial Sequence
  synthetic [barcode part1]
taggttgaccaccaac

SEQ ID NO: 37712 - DNA, 16 bp, Artificial Sequence
  synthetic [barcode part1]
tccacgcctaacaatt

SEQ ID NO: 37713 - DNA, 16 bp, Artificial Sequence
  synthetic [barcode part1]
tgttgcacacaacgtg

SEQ ID NO: 37714 - DNA, 16 bp, Artificial Sequence
  synthetic [barcode part1]
tgtcgaatcgcgtctc

SEQ ID NO: 37715 - DNA, 16 bp, Artificial Sequence
  synthetic [barcode part1]
tccgttctccagagtg

SEQ ID NO: 37716 - DNA, 16 bp, Artificial Sequence
  synthetic [barcode part1]
atactccggcctggtt

SEQ ID NO: 37717 - DNA, 16 bp, Artificial Sequence
  synthetic [barcode part1]
gatcgttgcagagacg

SEQ ID NO: 37718 - DNA, 16 bp, Artificial Sequence
  synthetic [barcode part1]
tgcgtgatccggtctt

SEQ ID NO: 37719 - DNA, 16 bp, Artificial Sequence
  synthetic [barcode part1]
tatccgttgccgcagt

SEQ ID NO: 37720 - DNA, 16 bp, Artificial Sequence
  synthetic [barcode part1]
gtaaggactggaccgt

SEQ ID NO: 37721 - DNA, 16 bp, Artificial Sequence
  synthetic [barcode part1]
cgagattggaatctcc

SEQ ID NO: 37722 - DNA, 16 bp, Artificial Sequence
  synthetic [barcode part1]
aagtgcgattgccgag

SEQ ID NO: 37723 - DNA, 16 bp, Artificial Sequence
  synthetic [barcode part1]
accacagtaggactct

SEQ ID NO: 37724 - DNA, 16 bp, Artificial Sequence
  synthetic [barcode part1]
gtcgtggtgaataggc

SEQ ID NO: 37725 - DNA, 16 bp, Artificial Sequence
  synthetic [barcode part1]
ttacgtcgccttcact

SEQ ID NO: 37726 - DNA, 16 bp, Artificial Sequence
  synthetic [barcode part1]
tggcgcgagaacaact

SEQ ID NO: 37727 - DNA, 16 bp, Artificial Sequence
  synthetic [barcode part1]
gatcctataccgcaag

SEQ ID NO: 37728 - DNA, 16 bp, Artificial Sequence
  synthetic [barcode part1]
cagtagttacaggaac

SEQ ID NO: 37729 - DNA, 16 bp, Artificial Sequence
  synthetic [barcode part1]
gtcacttagactcact

SEQ ID NO: 37730 - DNA, 16 bp, Artificial Sequence
  synthetic [barcode part1]
gatcgtattggtcttc

SEQ ID NO: 37731 - DNA, 16 bp, Artificial Sequence
  synthetic [barcode part1]
ccaggtaggtaggact

SEQ ID NO: 37732 - DNA, 16 bp, Artificial Sequence
  synthetic [barcode part1]
tcgccttgtataatcg

SEQ ID NO: 37733 - DNA, 16 bp, Artificial Sequence
  synthetic [barcode part1]
acgtacaccagttgac

SEQ ID NO: 37734 - DNA, 16 bp, Artificial Sequence
  synthetic [barcode part1]
tccgaattgtctcgcg

SEQ ID NO: 37735 - DNA, 16 bp, Artificial Sequence
  synthetic [barcode part1]
cacctcagatacttac

SEQ ID NO: 37736 - DNA, 16 bp, Artificial Sequence
  synthetic [barcode part1]
acgcgacgaagagttc

SEQ ID NO: 37737 - DNA, 16 bp, Artificial Sequence
  synthetic [barcode part1]
gaaggaacttctcctg

SEQ ID NO: 37738 - DNA, 16 bp, Artificial Sequence
  synthetic [barcode part1]
attcgaaccgttctgt

SEQ ID NO: 37739 - DNA, 16 bp, Artificial Sequence
  synthetic [barcode part1]
cctggaaggtcaactt

SEQ ID NO: 37740 - DNA, 16 bp, Artificial Sequence
  synthetic [barcode part1]
tgttcgttgtctgcct

SEQ ID NO: 37741 - DNA, 16 bp, Artificial Sequence
  synthetic [barcode part1]
atatccgaggtctacg

SEQ ID NO: 37742 - DNA, 16 bp, Artificial Sequence
  synthetic [barcode part1]
attggacaggcgtgac

SEQ ID NO: 37743 - DNA, 16 bp, Artificial Sequence
  synthetic [barcode part1]
tcactagtggtagtcg

SEQ ID NO: 37744 - DNA, 16 bp, Artificial Sequence
  synthetic [barcode part1]
agacggaacctatctc

SEQ ID NO: 37745 - DNA, 16 bp, Artificial Sequence
  synthetic [barcode part1]
gccgtctatagatctt

SEQ ID NO: 37746 - DNA, 16 bp, Artificial Sequence
  synthetic [barcode part1]
cctaagtcacttcgcg

SEQ ID NO: 37747 - DNA, 16 bp, Artificial Sequence
  synthetic [barcode part1]
ccttataccaacagtc

SEQ ID NO: 37748 - DNA, 16 bp, Artificial Sequence
  synthetic [barcode part1]
ccaactatcctggaag

SEQ ID NO: 37749 - DNA, 16 bp, Artificial Sequence
  synthetic [barcode part1]
gatcactggactatcg

SEQ ID NO: 37750 - DNA, 16 bp, Artificial Sequence
  synthetic [barcode part1]
ttcggcctggtacgtt

SEQ ID NO: 37751 - DNA, 16 bp, Artificial Sequence
  synthetic [barcode part1]
gagatcttgagactcc

SEQ ID NO: 37752 - DNA, 16 bp, Artificial Sequence
  synthetic [barcode part1]
gtactgaccaatacgc

SEQ ID NO: 37753 - DNA, 16 bp, Artificial Sequence
  synthetic [barcode part1]
gatacggcgttcttag

SEQ ID NO: 37754 - DNA, 16 bp, Artificial Sequence
  synthetic [barcode part1]
cctgtcacaactcttc

SEQ ID NO: 37755 - DNA, 16 bp, Artificial Sequence
  synthetic [barcode part1]
tggattcttgtcctag

SEQ ID NO: 37756 - DNA, 16 bp, Artificial Sequence
  synthetic [barcode part1]
gcgaaggaatccggtt

SEQ ID NO: 37757 - DNA, 16 bp, Artificial Sequence
  synthetic [barcode part1]
caacgtggccagaagt

SEQ ID NO: 37758 - DNA, 16 bp, Artificial Sequence
  synthetic [barcode part1]
tcagtaccacaaccag

SEQ ID NO: 37759 - DNA, 16 bp, Artificial Sequence
  synthetic [barcode part1]
gatctgtctgtcttag

SEQ ID NO: 37760 - DNA, 16 bp, Artificial Sequence
  synthetic [barcode part1]
caaggagatatcgatc

SEQ ID NO: 37761 - DNA, 16 bp, Artificial Sequence
  synthetic [barcode part1]
tcaagtcacacaagag

SEQ ID NO: 37762 - DNA, 16 bp, Artificial Sequence
  synthetic [barcode part1]
agaccagatcaacgcg

SEQ ID NO: 37763 - DNA, 16 bp, Artificial Sequence
  synthetic [barcode part1]
cagatcttaggcgttg

SEQ ID NO: 37764 - DNA, 16 bp, Artificial Sequence
  synthetic [barcode part1]
agacgtcgagtctgtt

SEQ ID NO: 37765 - DNA, 16 bp, Artificial Sequence
  synthetic [barcode part1]
ttctcgccgaactacg

SEQ ID NO: 37766 - DNA, 16 bp, Artificial Sequence
  synthetic [barcode part1]
gacgtaggcaactcag

SEQ ID NO: 37767 - DNA, 16 bp, Artificial Sequence
  synthetic [barcode part1]
ttccacactgacaact

SEQ ID NO: 37768 - DNA, 16 bp, Artificial Sequence
  synthetic [barcode part1]
gtcgagttccgtgtct

SEQ ID NO: 37769 - DNA, 16 bp, Artificial Sequence
  synthetic [barcode part1]
taggtacgatcacacc

SEQ ID NO: 37770 - DNA, 16 bp, Artificial Sequence
  synthetic [barcode part1]
agttcggtcggcaatt

SEQ ID NO: 37771 - DNA, 16 bp, Artificial Sequence
  synthetic [barcode part1]
agatcacaacacgaac

SEQ ID NO: 37772 - DNA, 16 bp, Artificial Sequence
  synthetic [barcode part1]
gtgtagtgacctcctc

SEQ ID NO: 37773 - DNA, 16 bp, Artificial Sequence
  synthetic [barcode part1]
cacgcctcttaacggt

SEQ ID NO: 37774 - DNA, 16 bp, Artificial Sequence
  synthetic [barcode part1]
agtgacttcgagttgc

SEQ ID NO: 37775 - DNA, 16 bp, Artificial Sequence
  synthetic [barcode part1]
gccgagtggtatagac

SEQ ID NO: 37776 - DNA, 16 bp, Artificial Sequence
  synthetic [barcode part1]
ttaactctattggcgc

SEQ ID NO: 37777 - DNA, 16 bp, Artificial Sequence
  synthetic [barcode part1]
ccggatcgttgttaag

SEQ ID NO: 37778 - DNA, 16 bp, Artificial Sequence
  synthetic [barcode part1]
tactcttactgccaag

SEQ ID NO: 37779 - DNA, 16 bp, Artificial Sequence
  synthetic [barcode part1]
ccacctactacggtac

SEQ ID NO: 37780 - DNA, 16 bp, Artificial Sequence
  synthetic [barcode part1]
aacggacagatcttag

SEQ ID NO: 37781 - DNA, 16 bp, Artificial Sequence
  synthetic [barcode part1]
atagagagtcgtcggc

SEQ ID NO: 37782 - DNA, 16 bp, Artificial Sequence
  synthetic [barcode part1]
tcctgtcctgtgagtg

SEQ ID NO: 37783 - DNA, 16 bp, Artificial Sequence
  synthetic [barcode part1]
atagtacctccggagt

SEQ ID NO: 37784 - DNA, 16 bp, Artificial Sequence
  synthetic [barcode part1]
atagtacgccgtggtt

SEQ ID NO: 37785 - DNA, 16 bp, Artificial Sequence
  synthetic [barcode part1]
gcgaattacgtggttc

SEQ ID NO: 37786 - DNA, 16 bp, Artificial Sequence
  synthetic [barcode part1]
gcgatcaccgaagagt

SEQ ID NO: 37787 - DNA, 16 bp, Artificial Sequence
  synthetic [barcode part1]
cgtaggactggtaacg

SEQ ID NO: 37788 - DNA, 16 bp, Artificial Sequence
  synthetic [barcode part1]
aagtggaacgacgcct

SEQ ID NO: 37789 - DNA, 16 bp, Artificial Sequence
  synthetic [barcode part1]
gtgataatccgtgaag

SEQ ID NO: 37790 - DNA, 16 bp, Artificial Sequence
  synthetic [barcode part1]
acggactcacaagtct

SEQ ID NO: 37791 - DNA, 16 bp, Artificial Sequence
  synthetic [barcode part1]
acagactcctctaatc

SEQ ID NO: 37792 - DNA, 16 bp, Artificial Sequence
  synthetic [barcode part1]
gcctcgaatattgcag

SEQ ID NO: 37793 - DNA, 16 bp, Artificial Sequence
  synthetic [barcode part1]
attgcctacttgtggt

SEQ ID NO: 37794 - DNA, 16 bp, Artificial Sequence
  synthetic [barcode part1]
gattacgccaatcttc

SEQ ID NO: 37795 - DNA, 16 bp, Artificial Sequence
  synthetic [barcode part1]
atccacttagagtcct

SEQ ID NO: 37796 - DNA, 16 bp, Artificial Sequence
  synthetic [barcode part1]
tgccacgtagttagtg

SEQ ID NO: 37797 - DNA, 16 bp, Artificial Sequence
  synthetic [barcode part1]
gcctacgtgactcttg

SEQ ID NO: 37798 - DNA, 16 bp, Artificial Sequence
  synthetic [barcode part1]
gagacgatactacctc

SEQ ID NO: 37799 - DNA, 16 bp, Artificial Sequence
  synthetic [barcode part1]
gacctccttctactgt

SEQ ID NO: 37800 - DNA, 16 bp, Artificial Sequence
  synthetic [barcode part1]
acggcaattcagtctg

SEQ ID NO: 37801 - DNA, 16 bp, Artificial Sequence
  synthetic [barcode part1]
gatcctaggacagacg

SEQ ID NO: 37802 - DNA, 16 bp, Artificial Sequence
  synthetic [barcode part1]
tccgtgtagtcgtcac

SEQ ID NO: 37803 - DNA, 16 bp, Artificial Sequence
  synthetic [barcode part1]
gcagtagttgttgtcg

SEQ ID NO: 37804 - DNA, 16 bp, Artificial Sequence
  synthetic [barcode part1]
atcagtacactccact

SEQ ID NO: 37805 - DNA, 16 bp, Artificial Sequence
  synthetic [barcode part1]
aagtactcgtccgagt

SEQ ID NO: 37806 - DNA, 16 bp, Artificial Sequence
  synthetic [barcode part1]
tcctaaccgcactggt

SEQ ID NO: 37807 - DNA, 16 bp, Artificial Sequence
  synthetic [barcode part1]
cctccgcaagttactg

SEQ ID NO: 37808 - DNA, 16 bp, Artificial Sequence
  synthetic [barcode part1]
tctgcggtctatcacg

SEQ ID NO: 37809 - DNA, 16 bp, Artificial Sequence
  synthetic [barcode part1]
gtgcacactaggactt

SEQ ID NO: 37810 - DNA, 16 bp, Artificial Sequence
  synthetic [barcode part1]
aacacgttgactgtgc

SEQ ID NO: 37811 - DNA, 16 bp, Artificial Sequence
  synthetic [barcode part1]
gaatcgtaagtgtgac

SEQ ID NO: 37812 - DNA, 16 bp, Artificial Sequence
  synthetic [barcode part1]
cagactgagaagtact

SEQ ID NO: 37813 - DNA, 16 bp, Artificial Sequence
  synthetic [barcode part1]
tgccgtcgcaatcgtt

SEQ ID NO: 37814 - DNA, 16 bp, Artificial Sequence
  synthetic [barcode part1]
gttgtctgcagatctt

SEQ ID NO: 37815 - DNA, 16 bp, Artificial Sequence
  synthetic [barcode part1]
gttctcgacgacttgc

SEQ ID NO: 37816 - DNA, 16 bp, Artificial Sequence
  synthetic [barcode part1]
accaagtaggcacgac

SEQ ID NO: 37817 - DNA, 16 bp, Artificial Sequence
  synthetic [barcode part1]
gaccgtccaagaacag

SEQ ID NO: 37818 - DNA, 16 bp, Artificial Sequence
  synthetic [barcode part1]
ccttaacagttgcact

SEQ ID NO: 37819 - DNA, 16 bp, Artificial Sequence
  synthetic [barcode part1]
tactagatacctccgt

SEQ ID NO: 37820 - DNA, 16 bp, Artificial Sequence
  synthetic [barcode part1]
tacgatattcgcctgt

SEQ ID NO: 37821 - DNA, 16 bp, Artificial Sequence
  synthetic [barcode part1]
tctactgtgacggagt

SEQ ID NO: 37822 - DNA, 16 bp, Artificial Sequence
  synthetic [barcode part1]
tgtatctgtagtctgc

SEQ ID NO: 37823 - DNA, 16 bp, Artificial Sequence
  synthetic [barcode part1]
tgataacctctgcact

SEQ ID NO: 37824 - DNA, 16 bp, Artificial Sequence
  synthetic [barcode part1]
agacggacttgtctac

SEQ ID NO: 37825 - DNA, 16 bp, Artificial Sequence
  synthetic [barcode part1]
tgtaagaattaggccg

SEQ ID NO: 37826 - DNA, 16 bp, Artificial Sequence
  synthetic [barcode part1]
ccacaaggtccttcgt

SEQ ID NO: 37827 - DNA, 16 bp, Artificial Sequence
  synthetic [barcode part1]
ccgtaggtacttcgtc

SEQ ID NO: 37828 - DNA, 16 bp, Artificial Sequence
  synthetic [barcode part1]
actgtagtgccacaac

SEQ ID NO: 37829 - DNA, 16 bp, Artificial Sequence
  synthetic [barcode part1]
tggagtctacgacact

SEQ ID NO: 37830 - DNA, 16 bp, Artificial Sequence
  synthetic [barcode part1]
ccgtcagtatacctcg

SEQ ID NO: 37831 - DNA, 16 bp, Artificial Sequence
  synthetic [barcode part1]
ccttcaggtacgttgc

SEQ ID NO: 37832 - DNA, 16 bp, Artificial Sequence
  synthetic [barcode part1]
caatctcgaccttcct

SEQ ID NO: 37833 - DNA, 16 bp, Artificial Sequence
  synthetic [barcode part1]
gcgtcctgaaggtatt

SEQ ID NO: 37834 - DNA, 16 bp, Artificial Sequence
  synthetic [barcode part1]
acacgtggaagaaggt

SEQ ID NO: 37835 - DNA, 16 bp, Artificial Sequence
  synthetic [barcode part1]
cgttaggcaagtcgtt

SEQ ID NO: 37836 - DNA, 16 bp, Artificial Sequence
  synthetic [barcode part1]
tactccgtaggtgtcc

SEQ ID NO: 37837 - DNA, 16 bp, Artificial Sequence
  synthetic [barcode part1]
attaccgcgcaccttg

SEQ ID NO: 37838 - DNA, 16 bp, Artificial Sequence
  synthetic [barcode part1]
ttcagacgcaattgcg

SEQ ID NO: 37839 - DNA, 16 bp, Artificial Sequence
  synthetic [barcode part1]
ttctgcgataccttcc

SEQ ID NO: 37840 - DNA, 16 bp, Artificial Sequence
  synthetic [barcode part1]
gaagatactaccgaac

SEQ ID NO: 37841 - DNA, 16 bp, Artificial Sequence
  synthetic [barcode part1]
gtacgtaacacgtgtc

SEQ ID NO: 37842 - DNA, 16 bp, Artificial Sequence
  synthetic [barcode part1]
cgacaacgactactgt

SEQ ID NO: 37843 - DNA, 16 bp, Artificial Sequence
  synthetic [barcode part1]
ccaggtctgtactctg

SEQ ID NO: 37844 - DNA, 16 bp, Artificial Sequence
  synthetic [barcode part1]
tctgtaccgcgttctt

SEQ ID NO: 37845 - DNA, 16 bp, Artificial Sequence
  synthetic [barcode part1]
gatctactgtcgcctg

SEQ ID NO: 37846 - DNA, 16 bp, Artificial Sequence
  synthetic [barcode part1]
ccgatcttatcctgtc

SEQ ID NO: 37847 - DNA, 16 bp, Artificial Sequence
  synthetic [barcode part1]
gcaccaacgtaagtct

SEQ ID NO: 37848 - DNA, 16 bp, Artificial Sequence
  synthetic [barcode part1]
agtactacgacgtcgt

SEQ ID NO: 37849 - DNA, 16 bp, Artificial Sequence
  synthetic [barcode part1]
tactcgttgtcgtagt

SEQ ID NO: 37850 - DNA, 16 bp, Artificial Sequence
  synthetic [barcode part1]
cggactaagttaccgt

SEQ ID NO: 37851 - DNA, 16 bp, Artificial Sequence
  synthetic [barcode part1]
cctgaatatcctctag

SEQ ID NO: 37852 - DNA, 16 bp, Artificial Sequence
  synthetic [barcode part1]
tctggaactaactggc

SEQ ID NO: 37853 - DNA, 16 bp, Artificial Sequence
  synthetic [barcode part1]
atactggaactcgtgc

SEQ ID NO: 37854 - DNA, 16 bp, Artificial Sequence
  synthetic [barcode part1]
agtcctccgcgttaac

SEQ ID NO: 37855 - DNA, 16 bp, Artificial Sequence
  synthetic [barcode part1]
ccagtcgttagagttg

SEQ ID NO: 37856 - DNA, 16 bp, Artificial Sequence
  synthetic [barcode part1]
gatagaagactacacc

SEQ ID NO: 37857 - DNA, 16 bp, Artificial Sequence
  synthetic [barcode part1]
cgcgacacaagtagac

SEQ ID NO: 37858 - DNA, 16 bp, Artificial Sequence
  synthetic [barcode part1]
attcaaggcaacaggt

SEQ ID NO: 37859 - DNA, 16 bp, Artificial Sequence
  synthetic [barcode part1]
ccagtatcgcagttag

SEQ ID NO: 37860 - DNA, 16 bp, Artificial Sequence
  synthetic [barcode part1]
atcgtccacgagtctc

SEQ ID NO: 37861 - DNA, 16 bp, Artificial Sequence
  synthetic [barcode part1]
acttctacgtccttgc

SEQ ID NO: 37862 - DNA, 16 bp, Artificial Sequence
  synthetic [barcode part1]
gtatcctggtccgact

SEQ ID NO: 37863 - DNA, 16 bp, Artificial Sequence
  synthetic [barcode part1]
agtcctaagatagacg

SEQ ID NO: 37864 - DNA, 16 bp, Artificial Sequence
  synthetic [barcode part1]
atagttacggtcgtgc

SEQ ID NO: 37865 - DNA, 16 bp, Artificial Sequence
  synthetic [barcode part1]
tctcttagaacgtctg

SEQ ID NO: 37866 - DNA, 16 bp, Artificial Sequence
  synthetic [barcode part1]
aatccaaggttgccgt

SEQ ID NO: 37867 - DNA, 16 bp, Artificial Sequence
  synthetic [barcode part1]
agtaccggaccttagt

SEQ ID NO: 37868 - DNA, 16 bp, Artificial Sequence
  synthetic [barcode part1]
ttagttcgtaaccacc

SEQ ID NO: 37869 - DNA, 16 bp, Artificial Sequence
  synthetic [barcode part1]
tctaactgccagtatc

SEQ ID NO: 37870 - DNA, 16 bp, Artificial Sequence
  synthetic [barcode part1]
gcactccactgagtct

SEQ ID NO: 37871 - DNA, 16 bp, Artificial Sequence
  synthetic [barcode part1]
atagtcgccgatctcc

SEQ ID NO: 37872 - DNA, 16 bp, Artificial Sequence
  synthetic [barcode part1]
cggtcaacgcagtatt

SEQ ID NO: 37873 - DNA, 16 bp, Artificial Sequence
  synthetic [barcode part1]
tgtccgcgacgttgtt

SEQ ID NO: 37874 - DNA, 16 bp, Artificial Sequence
  synthetic [barcode part1]
cgaggaatcctagttc

SEQ ID NO: 37875 - DNA, 16 bp, Artificial Sequence
  synthetic [barcode part1]
ccgtaatcagtgtcag

SEQ ID NO: 37876 - DNA, 16 bp, Artificial Sequence
  synthetic [barcode part1]
gcagtgttgtgacgtt

SEQ ID NO: 37877 - DNA, 16 bp, Artificial Sequence
  synthetic [barcode part1]
acagtcacacacaacc

SEQ ID NO: 37878 - DNA, 16 bp, Artificial Sequence
  synthetic [barcode part1]
ccgagaacgtatcgag

SEQ ID NO: 37879 - DNA, 16 bp, Artificial Sequence
  synthetic [barcode part1]
ttcctagacactggtt

SEQ ID NO: 37880 - DNA, 16 bp, Artificial Sequence
  synthetic [barcode part1]
tgactgtactcaggtg

SEQ ID NO: 37881 - DNA, 16 bp, Artificial Sequence
  synthetic [barcode part1]
aagttgcgttctcgcc

SEQ ID NO: 37882 - DNA, 16 bp, Artificial Sequence
  synthetic [barcode part1]
aagtggccgtggattg

SEQ ID NO: 37883 - DNA, 16 bp, Artificial Sequence
  synthetic [barcode part1]
atctcactaccagtgt

SEQ ID NO: 37884 - DNA, 16 bp, Artificial Sequence
  synthetic [barcode part1]
tatcctaggacttgtc

SEQ ID NO: 37885 - DNA, 16 bp, Artificial Sequence
  synthetic [barcode part1]
tgaacacgatcacacc

SEQ ID NO: 37886 - DNA, 16 bp, Artificial Sequence
  synthetic [barcode part1]
ataccgaaggataacc

SEQ ID NO: 37887 - DNA, 16 bp, Artificial Sequence
  synthetic [barcode part1]
cgtgtgaagtggtggt

SEQ ID NO: 37888 - DNA, 16 bp, Artificial Sequence
  synthetic [barcode part1]
ccacctgtgagacctt

SEQ ID NO: 37889 - DNA, 16 bp, Artificial Sequence
  synthetic [barcode part1]
gcgtattactccttag

SEQ ID NO: 37890 - DNA, 16 bp, Artificial Sequence
  synthetic [barcode part1]
tctgaaggagacttcc

SEQ ID NO: 37891 - DNA, 16 bp, Artificial Sequence
  synthetic [barcode part1]
tgtgtactcttcctcg

SEQ ID NO: 37892 - DNA, 16 bp, Artificial Sequence
  synthetic [barcode part1]
gcactcttgtactctc

SEQ ID NO: 37893 - DNA, 16 bp, Artificial Sequence
  synthetic [barcode part1]
agagtatccgacggtg

SEQ ID NO: 37894 - DNA, 16 bp, Artificial Sequence
  synthetic [barcode part1]
aggattcagacaggcc

SEQ ID NO: 37895 - DNA, 16 bp, Artificial Sequence
  synthetic [barcode part1]
cgtaactgtcgtcctg

SEQ ID NO: 37896 - DNA, 16 bp, Artificial Sequence
  synthetic [barcode part1]
atcggattgaggacgc

SEQ ID NO: 37897 - DNA, 16 bp, Artificial Sequence
  synthetic [barcode part1]
gatatatcgatcgcgc

SEQ ID NO: 37898 - DNA, 16 bp, Artificial Sequence
  synthetic [barcode part1]
gtccagagaacctact

SEQ ID NO: 37899 - DNA, 16 bp, Artificial Sequence
  synthetic [barcode part1]
gtccgtcgtagtacct

SEQ ID NO: 37900 - DNA, 16 bp, Artificial Sequence
  synthetic [barcode part1]
accgaatcttggtgac

SEQ ID NO: 37901 - DNA, 16 bp, Artificial Sequence
  synthetic [barcode part1]
ttagtcgccttcttcg

SEQ ID NO: 37902 - DNA, 16 bp, Artificial Sequence
  synthetic [barcode part1]
cactcctgaagatacg

SEQ ID NO: 37903 - DNA, 16 bp, Artificial Sequence
  synthetic [barcode part1]
tccaattcacaatcgc

SEQ ID NO: 37904 - DNA, 16 bp, Artificial Sequence
  synthetic [barcode part1]
tgcgaagactatcaag

SEQ ID NO: 37905 - DNA, 16 bp, Artificial Sequence
  synthetic [barcode part1]
ccaaccttattgacac

SEQ ID NO: 37906 - DNA, 16 bp, Artificial Sequence
  synthetic [barcode part1]
cgccgtcaatatattc

SEQ ID NO: 37907 - DNA, 16 bp, Artificial Sequence
  synthetic [barcode part1]
gcacttatccgtcgtg

SEQ ID NO: 37908 - DNA, 16 bp, Artificial Sequence
  synthetic [barcode part1]
tggtctacctgtgtcg

SEQ ID NO: 37909 - DNA, 16 bp, Artificial Sequence
  synthetic [barcode part1]
tgaagatcggaccacg

SEQ ID NO: 37910 - DNA, 16 bp, Artificial Sequence
  synthetic [barcode part1]
tccaaggagagtctct

SEQ ID NO: 37911 - DNA, 16 bp, Artificial Sequence
  synthetic [barcode part1]
tggtatcctattcgtg

SEQ ID NO: 37912 - DNA, 16 bp, Artificial Sequence
  synthetic [barcode part1]
cctaatcgccacacgt

SEQ ID NO: 37913 - DNA, 16 bp, Artificial Sequence
  synthetic [barcode part1]
acgttgactaagtgcc

SEQ ID NO: 37914 - DNA, 16 bp, Artificial Sequence
  synthetic [barcode part1]
cgtacgagtccgaatt

SEQ ID NO: 37915 - DNA, 16 bp, Artificial Sequence
  synthetic [barcode part1]
ccaacgaagaccactt

SEQ ID NO: 37916 - DNA, 16 bp, Artificial Sequence
  synthetic [barcode part1]
aacgactacgttcttc

SEQ ID NO: 37917 - DNA, 16 bp, Artificial Sequence
  synthetic [barcode part1]
gcgaagattggattac

SEQ ID NO: 37918 - DNA, 16 bp, Artificial Sequence
  synthetic [barcode part1]
tcacctctacgccaag

SEQ ID NO: 37919 - DNA, 16 bp, Artificial Sequence
  synthetic [barcode part1]
gtctagtctggactag

SEQ ID NO: 37920 - DNA, 16 bp, Artificial Sequence
  synthetic [barcode part1]
cgtgcgatattctgcc

SEQ ID NO: 37921 - DNA, 16 bp, Artificial Sequence
  synthetic [barcode part1]
tcactactccaagtgt

SEQ ID NO: 37922 - DNA, 16 bp, Artificial Sequence
  synthetic [barcode part1]
gcgcgacctaactctt

SEQ ID NO: 37923 - DNA, 16 bp, Artificial Sequence
  synthetic [barcode part1]
ttcagttgaccggaac

SEQ ID NO: 37924 - DNA, 16 bp, Artificial Sequence
  synthetic [barcode part1]
cgaccgaatcacaatc

SEQ ID NO: 37925 - DNA, 16 bp, Artificial Sequence
  synthetic [barcode part1]
gactgtataacacgcc

SEQ ID NO: 37926 - DNA, 16 bp, Artificial Sequence
  synthetic [barcode part1]
gaatagaatcctaggc

SEQ ID NO: 37927 - DNA, 16 bp, Artificial Sequence
  synthetic [barcode part1]
ttggttgccggaattg

SEQ ID NO: 37928 - DNA, 16 bp, Artificial Sequence
  synthetic [barcode part1]
tcggtattacacggtg

SEQ ID NO: 37929 - DNA, 16 bp, Artificial Sequence
  synthetic [barcode part1]
aaccggtccagaactt

SEQ ID NO: 37930 - DNA, 16 bp, Artificial Sequence
  synthetic [barcode part1]
aagtgtaagaggcgtg

SEQ ID NO: 37931 - DNA, 16 bp, Artificial Sequence
  synthetic [barcode part1]
ccttgtctaccacttg

SEQ ID NO: 37932 - DNA, 16 bp, Artificial Sequence
  synthetic [barcode part1]
cgaagaagatcctcct

SEQ ID NO: 37933 - DNA, 16 bp, Artificial Sequence
  synthetic [barcode part1]
tatacctgtggaggtc

SEQ ID NO: 37934 - DNA, 16 bp, Artificial Sequence
  synthetic [barcode part1]
ccaacttgcggtcgtt

SEQ ID NO: 37935 - DNA, 16 bp, Artificial Sequence
  synthetic [barcode part1]
gattcgaagaacgcgc

SEQ ID NO: 37936 - DNA, 16 bp, Artificial Sequence
  synthetic [barcode part1]
gtaccgatagtgaagt

SEQ ID NO: 37937 - DNA, 16 bp, Artificial Sequence
  synthetic [barcode part1]
gccaacgtatcttatc

SEQ ID NO: 37938 - DNA, 16 bp, Artificial Sequence
  synthetic [barcode part1]
tgtaagtccgcggatt

SEQ ID NO: 37939 - DNA, 16 bp, Artificial Sequence
  synthetic [barcode part1]
agactaatagtgcacg

SEQ ID NO: 37940 - DNA, 16 bp, Artificial Sequence
  synthetic [barcode part1]
acacgtaccaattggc

SEQ ID NO: 37941 - DNA, 16 bp, Artificial Sequence
  synthetic [barcode part1]
gtgccggagaataatt

SEQ ID NO: 37942 - DNA, 16 bp, Artificial Sequence
  synthetic [barcode part1]
tagaacacactgacag

SEQ ID NO: 37943 - DNA, 16 bp, Artificial Sequence
  synthetic [barcode part1]
tctactaaccgaggac

SEQ ID NO: 37944 - DNA, 16 bp, Artificial Sequence
  synthetic [barcode part1]
cactacaattggccag

SEQ ID NO: 37945 - DNA, 16 bp, Artificial Sequence
  synthetic [barcode part1]
gcgttaagtcacctcc

SEQ ID NO: 37946 - DNA, 16 bp, Artificial Sequence
  synthetic [barcode part1]
caatcgttagagagtg

SEQ ID NO: 37947 - DNA, 16 bp, Artificial Sequence
  synthetic [barcode part1]
cacgcacgttaactag

SEQ ID NO: 37948 - DNA, 16 bp, Artificial Sequence
  synthetic [barcode part1]
tggtccttcaactctc

SEQ ID NO: 37949 - DNA, 16 bp, Artificial Sequence
  synthetic [barcode part1]
tctgaaggaccaactc

SEQ ID NO: 37950 - DNA, 16 bp, Artificial Sequence
  synthetic [barcode part1]
ttatccgtgccacggt

SEQ ID NO: 37951 - DNA, 16 bp, Artificial Sequence
  synthetic [barcode part1]
gccttacaggtacctc

SEQ ID NO: 37952 - DNA, 16 bp, Artificial Sequence
  synthetic [barcode part1]
tcgatactagtgtgcg

SEQ ID NO: 37953 - DNA, 16 bp, Artificial Sequence
  synthetic [barcode part1]
taacgtccttaggacg

SEQ ID NO: 37954 - DNA, 16 bp, Artificial Sequence
  synthetic [barcode part1]
gatatacgaccgaagt

SEQ ID NO: 37955 - DNA, 16 bp, Artificial Sequence
  synthetic [barcode part1]
gcctatactccaccag

SEQ ID NO: 37956 - DNA, 16 bp, Artificial Sequence
  synthetic [barcode part1]
gtagacgaacagacag

SEQ ID NO: 37957 - DNA, 16 bp, Artificial Sequence
  synthetic [barcode part1]
cgtgagagttagaccg

SEQ ID NO: 37958 - DNA, 16 bp, Artificial Sequence
  synthetic [barcode part1]
tccgttattaggcgtt

SEQ ID NO: 37959 - DNA, 16 bp, Artificial Sequence
  synthetic [barcode part1]
acttgtgtcttcaacg

SEQ ID NO: 37960 - DNA, 16 bp, Artificial Sequence
  synthetic [barcode part1]
gtatccttcctgcact

SEQ ID NO: 37961 - DNA, 16 bp, Artificial Sequence
  synthetic [barcode part1]
atatctctcggcgacc

SEQ ID NO: 37962 - DNA, 16 bp, Artificial Sequence
  synthetic [barcode part1]
actataacgtcacggc

SEQ ID NO: 37963 - DNA, 16 bp, Artificial Sequence
  synthetic [barcode part1]
gttcagtgaggtgcag

SEQ ID NO: 37964 - DNA, 16 bp, Artificial Sequence
  synthetic [barcode part1]
gccgaacacagagatc

SEQ ID NO: 37965 - DNA, 16 bp, Artificial Sequence
  synthetic [barcode part1]
tctcgacaacttgcgc

SEQ ID NO: 37966 - DNA, 16 bp, Artificial Sequence
  synthetic [barcode part1]
acaaggactctcgtgt

SEQ ID NO: 37967 - DNA, 16 bp, Artificial Sequence
  synthetic [barcode part1]
cactagacaggttacc

SEQ ID NO: 37968 - DNA, 16 bp, Artificial Sequence
  synthetic [barcode part1]
aactgtcttgcgcctg

SEQ ID NO: 37969 - DNA, 16 bp, Artificial Sequence
  synthetic [barcode part1]
actggccaattagtcg

SEQ ID NO: 37970 - DNA, 16 bp, Artificial Sequence
  synthetic [barcode part1]
tacgacgtccactcgt

SEQ ID NO: 37971 - DNA, 16 bp, Artificial Sequence
  synthetic [barcode part1]
gcgtagactaccagag

SEQ ID NO: 37972 - DNA, 16 bp, Artificial Sequence
  synthetic [barcode part1]
gtagtgtcgatcagtc

SEQ ID NO: 37973 - DNA, 16 bp, Artificial Sequence
  synthetic [barcode part1]
agttcttgtcacctcc

SEQ ID NO: 37974 - DNA, 16 bp, Artificial Sequence
  synthetic [barcode part1]
accggcaatagaatac

SEQ ID NO: 37975 - DNA, 16 bp, Artificial Sequence
  synthetic [barcode part1]
tggtaacgagacgcac

SEQ ID NO: 37976 - DNA, 16 bp, Artificial Sequence
  synthetic [barcode part1]
acaggcacgttgcaag

SEQ ID NO: 37977 - DNA, 16 bp, Artificial Sequence
  synthetic [barcode part1]
gactacaacgccaatc

SEQ ID NO: 37978 - DNA, 16 bp, Artificial Sequence
  synthetic [barcode part1]
ttattgcaagtccacc

SEQ ID NO: 37979 - DNA, 16 bp, Artificial Sequence
  synthetic [barcode part1]
tgtgatacgccacagt

SEQ ID NO: 37980 - DNA, 16 bp, Artificial Sequence
  synthetic [barcode part1]
gaggcaagagttcgtc

SEQ ID NO: 37981 - DNA, 16 bp, Artificial Sequence
  synthetic [barcode part1]
gacagaactcctgact

SEQ ID NO: 37982 - DNA, 16 bp, Artificial Sequence
  synthetic [barcode part1]
tagtcttgttggcgcc

SEQ ID NO: 37983 - DNA, 16 bp, Artificial Sequence
  synthetic [barcode part1]
tcacaggttcgatctt

SEQ ID NO: 37984 - DNA, 16 bp, Artificial Sequence
  synthetic [barcode part1]
tcaacacgtaccagtg

SEQ ID NO: 37985 - DNA, 16 bp, Artificial Sequence
  synthetic [barcode part1]
cgtcggataagaatac

SEQ ID NO: 37986 - DNA, 16 bp, Artificial Sequence
  synthetic [barcode part1]
tctctgagaggaacct

SEQ ID NO: 37987 - DNA, 16 bp, Artificial Sequence
  synthetic [barcode part1]
gcagaacttgtctcag

SEQ ID NO: 37988 - DNA, 16 bp, Artificial Sequence
  synthetic [barcode part1]
gtactcaagatccacg

SEQ ID NO: 37989 - DNA, 16 bp, Artificial Sequence
  synthetic [barcode part1]
gccttgtatcttccac

SEQ ID NO: 37990 - DNA, 16 bp, Artificial Sequence
  synthetic [barcode part1]
aacgttggtgtacgtc

SEQ ID NO: 37991 - DNA, 16 bp, Artificial Sequence
  synthetic [barcode part1]
tagagtctgcaacacc

SEQ ID NO: 37992 - DNA, 16 bp, Artificial Sequence
  synthetic [barcode part1]
gtgttacaacgagtag

SEQ ID NO: 37993 - DNA, 16 bp, Artificial Sequence
  synthetic [barcode part1]
ttatcggccaggttag

SEQ ID NO: 37994 - DNA, 16 bp, Artificial Sequence
  synthetic [barcode part1]
aacgcagttgcacttg

SEQ ID NO: 37995 - DNA, 16 bp, Artificial Sequence
  synthetic [barcode part1]
tatatagaggccgaac

SEQ ID NO: 37996 - DNA, 16 bp, Artificial Sequence
  synthetic [barcode part1]
gtctagttctcgtgcg

SEQ ID NO: 37997 - DNA, 16 bp, Artificial Sequence
  synthetic [barcode part1]
gttcagattacaggcc

SEQ ID NO: 37998 - DNA, 16 bp, Artificial Sequence
  synthetic [barcode part1]
cgtcgaaccgttaagt

SEQ ID NO: 37999 - DNA, 16 bp, Artificial Sequence
  synthetic [barcode part1]
attctcgacttggtgt

SEQ ID NO: 38000 - DNA, 16 bp, Artificial Sequence
  synthetic [barcode part1]
tgactggaggatctct

SEQ ID NO: 38001 - DNA, 16 bp, Artificial Sequence
  synthetic [barcode part1]
ccttgtcgttcgcaag

SEQ ID NO: 38002 - DNA, 16 bp, Artificial Sequence
  synthetic [barcode part1]
cagtgttgcctacctg

SEQ ID NO: 38003 - DNA, 16 bp, Artificial Sequence
  synthetic [barcode part1]
gtgattctactcctag

SEQ ID NO: 38004 - DNA, 16 bp, Artificial Sequence
  synthetic [barcode part1]
aggacgttggtaaccg

SEQ ID NO: 38005 - DNA, 16 bp, Artificial Sequence
  synthetic [barcode part1]
cgaccacaatataccg

SEQ ID NO: 38006 - DNA, 16 bp, Artificial Sequence
  synthetic [barcode part1]
acgcaagacgactcag

SEQ ID NO: 38007 - DNA, 16 bp, Artificial Sequence
  synthetic [barcode part1]
tgttagactgtgcctt

SEQ ID NO: 38008 - DNA, 16 bp, Artificial Sequence
  synthetic [barcode part1]
gttgagtaggttgtcc

SEQ ID NO: 38009 - DNA, 16 bp, Artificial Sequence
  synthetic [barcode part1]
tcctgtaaccgaactt

SEQ ID NO: 38010 - DNA, 16 bp, Artificial Sequence
  synthetic [barcode part1]
gttgcctagacctacc

SEQ ID NO: 38011 - DNA, 16 bp, Artificial Sequence
  synthetic [barcode part1]
tagtaccgtggtatcg

SEQ ID NO: 38012 - DNA, 16 bp, Artificial Sequence
  synthetic [barcode part1]
agagagaccgattgag

SEQ ID NO: 38013 - DNA, 16 bp, Artificial Sequence
  synthetic [barcode part1]
cacgtaacggaaggtc

SEQ ID NO: 38014 - DNA, 16 bp, Artificial Sequence
  synthetic [barcode part1]
agttgcgtctcggtct

SEQ ID NO: 38015 - DNA, 16 bp, Artificial Sequence
  synthetic [barcode part1]
ttattgatctcgtgcg

SEQ ID NO: 38016 - DNA, 16 bp, Artificial Sequence
  synthetic [barcode part1]
tcgcgtgttccttgag

SEQ ID NO: 38017 - DNA, 16 bp, Artificial Sequence
  synthetic [barcode part1]
cgattcttgtggttgt

SEQ ID NO: 38018 - DNA, 16 bp, Artificial Sequence
  synthetic [barcode part1]
tccgtactcagatcgc

SEQ ID NO: 38019 - DNA, 16 bp, Artificial Sequence
  synthetic [barcode part1]
taggactaccaactgc

SEQ ID NO: 38020 - DNA, 16 bp, Artificial Sequence
  synthetic [barcode part1]
tagagtcggttgactc

SEQ ID NO: 38021 - DNA, 16 bp, Artificial Sequence
  synthetic [barcode part1]
aacgtggcggattacg

SEQ ID NO: 38022 - DNA, 16 bp, Artificial Sequence
  synthetic [barcode part1]
tgtgacttcaggtacg

SEQ ID NO: 38023 - DNA, 16 bp, Artificial Sequence
  synthetic [barcode part1]
acgtgttgagtcggag

SEQ ID NO: 38024 - DNA, 16 bp, Artificial Sequence
  synthetic [barcode part1]
caattctcgcgaccac

SEQ ID NO: 38025 - DNA, 16 bp, Artificial Sequence
  synthetic [barcode part1]
ttacggatagaagacc

SEQ ID NO: 38026 - DNA, 16 bp, Artificial Sequence
  synthetic [barcode part1]
attaggcacctaacgc

SEQ ID NO: 38027 - DNA, 16 bp, Artificial Sequence
  synthetic [barcode part1]
gtatcggaggagtcgt

SEQ ID NO: 38028 - DNA, 16 bp, Artificial Sequence
  synthetic [barcode part1]
acaaccaatcgcgtac

SEQ ID NO: 38029 - DNA, 16 bp, Artificial Sequence
  synthetic [barcode part1]
gcctgagaatacttgc

SEQ ID NO: 38030 - DNA, 16 bp, Artificial Sequence
  synthetic [barcode part1]
gtggacttcaggtgtt

SEQ ID NO: 38031 - DNA, 16 bp, Artificial Sequence
  synthetic [barcode part1]
tacaccaggagttaag

SEQ ID NO: 38032 - DNA, 16 bp, Artificial Sequence
  synthetic [barcode part1]
aaggattacgcgccag

SEQ ID NO: 38033 - DNA, 16 bp, Artificial Sequence
  synthetic [barcode part1]
acggtgaccgttattg

SEQ ID NO: 38034 - DNA, 16 bp, Artificial Sequence
  synthetic [barcode part1]
aagtacctctgaacgc

SEQ ID NO: 38035 - DNA, 16 bp, Artificial Sequence
  synthetic [barcode part1]
tgaccgaaccgtaact

SEQ ID NO: 38036 - DNA, 16 bp, Artificial Sequence
  synthetic [barcode part1]
atcttcactcgcactc

SEQ ID NO: 38037 - DNA, 16 bp, Artificial Sequence
  synthetic [barcode part1]
atcactggtcaggttg

SEQ ID NO: 38038 - DNA, 16 bp, Artificial Sequence
  synthetic [barcode part1]
cgtataaccaccgcct

SEQ ID NO: 38039 - DNA, 16 bp, Artificial Sequence
  synthetic [barcode part1]
tgattgcaccttctag

SEQ ID NO: 38040 - DNA, 16 bp, Artificial Sequence
  synthetic [barcode part1]
attaacgtccggttct

SEQ ID NO: 38041 - DNA, 16 bp, Artificial Sequence
  synthetic [barcode part1]
atactcgcacctgaag

SEQ ID NO: 38042 - DNA, 16 bp, Artificial Sequence
  synthetic [barcode part1]
agaacaacaggacgac

SEQ ID NO: 38043 - DNA, 16 bp, Artificial Sequence
  synthetic [barcode part1]
aacgacgcgagtgttg

SEQ ID NO: 38044 - DNA, 16 bp, Artificial Sequence
  synthetic [barcode part1]
acctaagtctgaacgc

SEQ ID NO: 38045 - DNA, 16 bp, Artificial Sequence
  synthetic [barcode part1]
cgcctagtggtaagag

SEQ ID NO: 38046 - DNA, 16 bp, Artificial Sequence
  synthetic [barcode part1]
gcgcgtgcaatattgt

SEQ ID NO: 38047 - DNA, 16 bp, Artificial Sequence
  synthetic [barcode part1]
ccttgtcgtaacgaag

SEQ ID NO: 38048 - DNA, 16 bp, Artificial Sequence
  synthetic [barcode part1]
acctagaggacaatac

SEQ ID NO: 38049 - DNA, 16 bp, Artificial Sequence
  synthetic [barcode part1]
tgcacaactaccgtcc

SEQ ID NO: 38050 - DNA, 16 bp, Artificial Sequence
  synthetic [barcode part1]
ccacactatccagtgc

SEQ ID NO: 38051 - DNA, 16 bp, Artificial Sequence
  synthetic [barcode part1]
tcgagttatacaggag

SEQ ID NO: 38052 - DNA, 16 bp, Artificial Sequence
  synthetic [barcode part1]
tacttggtacgccaag

SEQ ID NO: 38053 - DNA, 16 bp, Artificial Sequence
  synthetic [barcode part1]
ttcaataacgaaggcg

SEQ ID NO: 38054 - DNA, 16 bp, Artificial Sequence
  synthetic [barcode part1]
gtcgagacggttacag

SEQ ID NO: 38055 - DNA, 16 bp, Artificial Sequence
  synthetic [barcode part1]
tgcggaagtatccttg

SEQ ID NO: 38056 - DNA, 16 bp, Artificial Sequence
  synthetic [barcode part1]
ttgacttgcaactgtc

SEQ ID NO: 38057 - DNA, 16 bp, Artificial Sequence
  synthetic [barcode part1]
taatccttagtcacgc

SEQ ID NO: 38058 - DNA, 16 bp, Artificial Sequence
  synthetic [barcode part1]
cctcggttgattctct

SEQ ID NO: 38059 - DNA, 16 bp, Artificial Sequence
  synthetic [barcode part1]
acaagtatcacctgcg

SEQ ID NO: 38060 - DNA, 16 bp, Artificial Sequence
  synthetic [barcode part1]
aagattggccacttcg

SEQ ID NO: 38061 - DNA, 16 bp, Artificial Sequence
  synthetic [barcode part1]
aactaaggttcgaacg

SEQ ID NO: 38062 - DNA, 16 bp, Artificial Sequence
  synthetic [barcode part1]
atcggagagtcaagag

SEQ ID NO: 38063 - DNA, 16 bp, Artificial Sequence
  synthetic [barcode part1]
caaggagtgactgtgc

SEQ ID NO: 38064 - DNA, 16 bp, Artificial Sequence
  synthetic [barcode part1]
gttagaactccgatcg

SEQ ID NO: 38065 - DNA, 16 bp, Artificial Sequence
  synthetic [barcode part1]
gatcgcctcgtacttg

SEQ ID NO: 38066 - DNA, 16 bp, Artificial Sequence
  synthetic [barcode part1]
ttcggtaagtgactcg

SEQ ID NO: 38067 - DNA, 16 bp, Artificial Sequence
  synthetic [barcode part1]
cgatacttacttaccg

SEQ ID NO: 38068 - DNA, 16 bp, Artificial Sequence
  synthetic [barcode part1]
gcggttgtatagtcac

SEQ ID NO: 38069 - DNA, 16 bp, Artificial Sequence
  synthetic [barcode part1]
gtggccgacactaatt

SEQ ID NO: 38070 - DNA, 16 bp, Artificial Sequence
  synthetic [barcode part1]
tcggtcgtaactaacg

SEQ ID NO: 38071 - DNA, 16 bp, Artificial Sequence
  synthetic [barcode part1]
tcagtggcaggaacgt

SEQ ID NO: 38072 - DNA, 16 bp, Artificial Sequence
  synthetic [barcode part1]
attgacacctgactct

SEQ ID NO: 38073 - DNA, 16 bp, Artificial Sequence
  synthetic [barcode part1]
tagttggtcaggactc

SEQ ID NO: 38074 - DNA, 16 bp, Artificial Sequence
  synthetic [barcode part1]
cacctcgatctacggt

SEQ ID NO: 38075 - DNA, 16 bp, Artificial Sequence
  synthetic [barcode part1]
cctaactgtcgcgtgt

SEQ ID NO: 38076 - DNA, 16 bp, Artificial Sequence
  synthetic [barcode part1]
gcactattctaggacg

SEQ ID NO: 38077 - DNA, 16 bp, Artificial Sequence
  synthetic [barcode part1]
accagtgcaccttatt

SEQ ID NO: 38078 - DNA, 16 bp, Artificial Sequence
  synthetic [barcode part1]
tgcagacacagtaagt

SEQ ID NO: 38079 - DNA, 16 bp, Artificial Sequence
  synthetic [barcode part1]
cgacacagttggaggt

SEQ ID NO: 38080 - DNA, 16 bp, Artificial Sequence
  synthetic [barcode part1]
tagatactctccggtt

SEQ ID NO: 38081 - DNA, 16 bp, Artificial Sequence
  synthetic [barcode part1]
cagtacggtgtaacct

SEQ ID NO: 38082 - DNA, 16 bp, Artificial Sequence
  synthetic [barcode part1]
cctgaattgaagagtg

SEQ ID NO: 38083 - DNA, 16 bp, Artificial Sequence
  synthetic [barcode part1]
cgcctgtagtattgtt

SEQ ID NO: 38084 - DNA, 16 bp, Artificial Sequence
  synthetic [barcode part1]
aaccagtcaacactgc

SEQ ID NO: 38085 - DNA, 16 bp, Artificial Sequence
  synthetic [barcode part1]
aaggaagtgcgatacg

SEQ ID NO: 38086 - DNA, 16 bp, Artificial Sequence
  synthetic [barcode part1]
atactcctggttcagt

SEQ ID NO: 38087 - DNA, 16 bp, Artificial Sequence
  synthetic [barcode part1]
cgtggtaacgatacct

SEQ ID NO: 38088 - DNA, 16 bp, Artificial Sequence
  synthetic [barcode part1]
tgtctgtgcgatactt

SEQ ID NO: 38089 - DNA, 16 bp, Artificial Sequence
  synthetic [barcode part1]
gactcaagattcggtc

SEQ ID NO: 38090 - DNA, 16 bp, Artificial Sequence
  synthetic [barcode part1]
cctaagagttggtcac

SEQ ID NO: 38091 - DNA, 16 bp, Artificial Sequence
  synthetic [barcode part1]
tagtagtaggacacgt

SEQ ID NO: 38092 - DNA, 16 bp, Artificial Sequence
  synthetic [barcode part1]
acacgtgatacgcgtt

SEQ ID NO: 38093 - DNA, 16 bp, Artificial Sequence
  synthetic [barcode part1]
acgccgtattctgaag

SEQ ID NO: 38094 - DNA, 16 bp, Artificial Sequence
  synthetic [barcode part1]
ccagtgcgattccttg

SEQ ID NO: 38095 - DNA, 16 bp, Artificial Sequence
  synthetic [barcode part1]
atctggacaccgttcc

SEQ ID NO: 38096 - DNA, 16 bp, Artificial Sequence
  synthetic [barcode part1]
tcttcggaccgtacac

SEQ ID NO: 38097 - DNA, 16 bp, Artificial Sequence
  synthetic [barcode part1]
gttaggtgcaacttgc

SEQ ID NO: 38098 - DNA, 16 bp, Artificial Sequence
  synthetic [barcode part1]
tggcaatcttcgcgtc

SEQ ID NO: 38099 - DNA, 16 bp, Artificial Sequence
  synthetic [barcode part1]
gcactggtagtaggac

SEQ ID NO: 38100 - DNA, 16 bp, Artificial Sequence
  synthetic [barcode part1]
tctatcacggtaggac

SEQ ID NO: 38101 - DNA, 16 bp, Artificial Sequence
  synthetic [barcode part1]
taattagacgccacgc

SEQ ID NO: 38102 - DNA, 16 bp, Artificial Sequence
  synthetic [barcode part1]
caagtacttggtacgc

SEQ ID NO: 38103 - DNA, 16 bp, Artificial Sequence
  synthetic [barcode part1]
tgcaccgtgtagttag

SEQ ID NO: 38104 - DNA, 16 bp, Artificial Sequence
  synthetic [barcode part1]
tgtgcagtccaatctt

SEQ ID NO: 38105 - DNA, 16 bp, Artificial Sequence
  synthetic [barcode part1]
atcgtcaatatcctcg

SEQ ID NO: 38106 - DNA, 16 bp, Artificial Sequence
  synthetic [barcode part1]
acgtggtcagttacgt

SEQ ID NO: 38107 - DNA, 16 bp, Artificial Sequence
  synthetic [barcode part1]
gttgttggactcagtg

SEQ ID NO: 38108 - DNA, 16 bp, Artificial Sequence
  synthetic [barcode part1]
tcttctaggtacgccg

SEQ ID NO: 38109 - DNA, 16 bp, Artificial Sequence
  synthetic [barcode part1]
gcacctgacttgtaag

SEQ ID NO: 38110 - DNA, 16 bp, Artificial Sequence
  synthetic [barcode part1]
tgtcactggtgacagt

SEQ ID NO: 38111 - DNA, 16 bp, Artificial Sequence
  synthetic [barcode part1]
acgttccaactgttac

SEQ ID NO: 38112 - DNA, 16 bp, Artificial Sequence
  synthetic [barcode part1]
acaacctacggtctag

SEQ ID NO: 38113 - DNA, 16 bp, Artificial Sequence
  synthetic [barcode part1]
gattggtcgatcaacc

SEQ ID NO: 38114 - DNA, 16 bp, Artificial Sequence
  synthetic [barcode part1]
atctatctatcgtggc

SEQ ID NO: 38115 - DNA, 16 bp, Artificial Sequence
  synthetic [barcode part1]
ccaattgccttggaag

SEQ ID NO: 38116 - DNA, 16 bp, Artificial Sequence
  synthetic [barcode part1]
aggttctatcgcagtg

SEQ ID NO: 38117 - DNA, 16 bp, Artificial Sequence
  synthetic [barcode part1]
gatcgccagtaatctg

SEQ ID NO: 38118 - DNA, 16 bp, Artificial Sequence
  synthetic [barcode part1]
aagtaaccgtgaatcg

SEQ ID NO: 38119 - DNA, 16 bp, Artificial Sequence
  synthetic [barcode part1]
cctactcacggataag

SEQ ID NO: 38120 - DNA, 16 bp, Artificial Sequence
  synthetic [barcode part1]
tgtgacgttcgcctgt

SEQ ID NO: 38121 - DNA, 16 bp, Artificial Sequence
  synthetic [barcode part1]
cacacctagtaattcc

SEQ ID NO: 38122 - DNA, 16 bp, Artificial Sequence
  synthetic [barcode part1]
agaacgcgaagtacag

SEQ ID NO: 38123 - DNA, 16 bp, Artificial Sequence
  synthetic [barcode part1]
tggtcctcggtgtatc

SEQ ID NO: 38124 - DNA, 16 bp, Artificial Sequence
  synthetic [barcode part1]
gagaagaatcgtgacg

SEQ ID NO: 38125 - DNA, 16 bp, Artificial Sequence
  synthetic [barcode part1]
accagattccaacgac

SEQ ID NO: 38126 - DNA, 16 bp, Artificial Sequence
  synthetic [barcode part1]
cggagaattctgatcc

SEQ ID NO: 38127 - DNA, 16 bp, Artificial Sequence
  synthetic [barcode part1]
aggttcggttcaggtt

SEQ ID NO: 38128 - DNA, 16 bp, Artificial Sequence
  synthetic [barcode part1]
attcgaaccgtggact

SEQ ID NO: 38129 - DNA, 16 bp, Artificial Sequence
  synthetic [barcode part1]
cgtactaggtctcctg

SEQ ID NO: 38130 - DNA, 16 bp, Artificial Sequence
  synthetic [barcode part1]
acgccactactacaag

SEQ ID NO: 38131 - DNA, 16 bp, Artificial Sequence
  synthetic [barcode part1]
gactcagagtctgact

SEQ ID NO: 38132 - DNA, 16 bp, Artificial Sequence
  synthetic [barcode part1]
actaacctacgcgtag

SEQ ID NO: 38133 - DNA, 16 bp, Artificial Sequence
  synthetic [barcode part1]
aaggcaacttagacgt

SEQ ID NO: 38134 - DNA, 16 bp, Artificial Sequence
  synthetic [barcode part1]
tcaagtgacgagttcc

SEQ ID NO: 38135 - DNA, 16 bp, Artificial Sequence
  synthetic [barcode part1]
gagacagttgtgaatc

SEQ ID NO: 38136 - DNA, 16 bp, Artificial Sequence
  synthetic [barcode part1]
cactcctccgataacg

SEQ ID NO: 38137 - DNA, 16 bp, Artificial Sequence
  synthetic [barcode part1]
gtggtgatatcctacg

SEQ ID NO: 38138 - DNA, 16 bp, Artificial Sequence
  synthetic [barcode part1]
gagattcagtgaacac

SEQ ID NO: 38139 - DNA, 16 bp, Artificial Sequence
  synthetic [barcode part1]
aagttgccgagttgtc

SEQ ID NO: 38140 - DNA, 16 bp, Artificial Sequence
  synthetic [barcode part1]
agacttatccgactct

SEQ ID NO: 38141 - DNA, 16 bp, Artificial Sequence
  synthetic [barcode part1]
cggacctaagtggtag

SEQ ID NO: 38142 - DNA, 16 bp, Artificial Sequence
  synthetic [barcode part1]
tgttctatccgtcacc

SEQ ID NO: 38143 - DNA, 16 bp, Artificial Sequence
  synthetic [barcode part1]
atctacgaattgcgcg

SEQ ID NO: 38144 - DNA, 16 bp, Artificial Sequence
  synthetic [barcode part1]
tcctcttatcggtcac

SEQ ID NO: 38145 - DNA, 16 bp, Artificial Sequence
  synthetic [barcode part1]
aggccggtgactatag

SEQ ID NO: 38146 - DNA, 16 bp, Artificial Sequence
  synthetic [barcode part1]
gcgttaggtatctggt

SEQ ID NO: 38147 - DNA, 16 bp, Artificial Sequence
  synthetic [barcode part1]
tcgagtatcgtaggtc

SEQ ID NO: 38148 - DNA, 16 bp, Artificial Sequence
  synthetic [barcode part1]
acctaccaccttaggc

SEQ ID NO: 38149 - DNA, 16 bp, Artificial Sequence
  synthetic [barcode part1]
gtaacctgttcttgtg

SEQ ID NO: 38150 - DNA, 16 bp, Artificial Sequence
  synthetic [barcode part1]
aagtagttgtaccgag

SEQ ID NO: 38151 - DNA, 16 bp, Artificial Sequence
  synthetic [barcode part1]
gcagtccgagtgtaag

SEQ ID NO: 38152 - DNA, 16 bp, Artificial Sequence
  synthetic [barcode part1]
tctgtccgtgagtaag

SEQ ID NO: 38153 - DNA, 16 bp, Artificial Sequence
  synthetic [barcode part1]
tcagttgcacaacgtg

SEQ ID NO: 38154 - DNA, 16 bp, Artificial Sequence
  synthetic [barcode part1]
cctgactaacctcttc

SEQ ID NO: 38155 - DNA, 16 bp, Artificial Sequence
  synthetic [barcode part1]
gtgataccgtgatacc

SEQ ID NO: 38156 - DNA, 16 bp, Artificial Sequence
  synthetic [barcode part1]
gacagtctcttgtgtt

SEQ ID NO: 38157 - DNA, 16 bp, Artificial Sequence
  synthetic [barcode part1]
gttcttacaagtcacc

SEQ ID NO: 38158 - DNA, 16 bp, Artificial Sequence
  synthetic [barcode part1]
cagtgcgtaacgagac

SEQ ID NO: 38159 - DNA, 16 bp, Artificial Sequence
  synthetic [barcode part1]
gattcggtgcgttcct

SEQ ID NO: 38160 - DNA, 16 bp, Artificial Sequence
  synthetic [barcode part1]
gacgactctaggttgt

SEQ ID NO: 38161 - DNA, 16 bp, Artificial Sequence
  synthetic [barcode part1]
tcgattgaactggtcg

SEQ ID NO: 38162 - DNA, 16 bp, Artificial Sequence
  synthetic [barcode part1]
gcaggtatctactcag

SEQ ID NO: 38163 - DNA, 16 bp, Artificial Sequence
  synthetic [barcode part1]
gaaggaccttgtggac

SEQ ID NO: 38164 - DNA, 16 bp, Artificial Sequence
  synthetic [barcode part1]
gaatccgtacttcgtt

SEQ ID NO: 38165 - DNA, 16 bp, Artificial Sequence
  synthetic [barcode part1]
gccaattctagaaccg

SEQ ID NO: 38166 - DNA, 16 bp, Artificial Sequence
  synthetic [barcode part1]
ccagacgagtagagtc

SEQ ID NO: 38167 - DNA, 16 bp, Artificial Sequence
  synthetic [barcode part1]
tgcgaatcggatactc

SEQ ID NO: 38168 - DNA, 16 bp, Artificial Sequence
  synthetic [barcode part1]
gtagtggacaaccgtg

SEQ ID NO: 38169 - DNA, 16 bp, Artificial Sequence
  synthetic [barcode part1]
gccaatattcacggac

SEQ ID NO: 38170 - DNA, 16 bp, Artificial Sequence
  synthetic [barcode part1]
tcgatccaagtcagac

SEQ ID NO: 38171 - DNA, 16 bp, Artificial Sequence
  synthetic [barcode part1]
gtacttcgacctgatt

SEQ ID NO: 38172 - DNA, 16 bp, Artificial Sequence
  synthetic [barcode part1]
cgtcgttacaattgtc

SEQ ID NO: 38173 - DNA, 16 bp, Artificial Sequence
  synthetic [barcode part1]
tacaggtagacggtgc

SEQ ID NO: 38174 - DNA, 16 bp, Artificial Sequence
  synthetic [barcode part1]
cacacttgacagtctt

SEQ ID NO: 38175 - DNA, 16 bp, Artificial Sequence
  synthetic [barcode part1]
gtactctgtcgccagt

SEQ ID NO: 38176 - DNA, 16 bp, Artificial Sequence
  synthetic [barcode part1]
aacagtcggaggtacc

SEQ ID NO: 38177 - DNA, 16 bp, Artificial Sequence
  synthetic [barcode part1]
tgcggaacggtaatcg

SEQ ID NO: 38178 - DNA, 16 bp, Artificial Sequence
  synthetic [barcode part1]
aagatagtcgtggatc

SEQ ID NO: 38179 - DNA, 16 bp, Artificial Sequence
  synthetic [barcode part1]
gatcaggactcttcag

SEQ ID NO: 38180 - DNA, 16 bp, Artificial Sequence
  synthetic [barcode part1]
acgaggaccttatacc

SEQ ID NO: 38181 - DNA, 16 bp, Artificial Sequence
  synthetic [barcode part1]
gttcctgtgaggatac

SEQ ID NO: 38182 - DNA, 16 bp, Artificial Sequence
  synthetic [barcode part1]
acagtgttggtaccac

SEQ ID NO: 38183 - DNA, 16 bp, Artificial Sequence
  synthetic [barcode part1]
ttgcaggacaaggcgt

SEQ ID NO: 38184 - DNA, 16 bp, Artificial Sequence
  synthetic [barcode part1]
gccttcgagattactt

SEQ ID NO: 38185 - DNA, 16 bp, Artificial Sequence
  synthetic [barcode part1]
cacagagtggcgattg

SEQ ID NO: 38186 - DNA, 16 bp, Artificial Sequence
  synthetic [barcode part1]
taccttgtgtctgagt

SEQ ID NO: 38187 - DNA, 16 bp, Artificial Sequence
  synthetic [barcode part1]
tattcgtgttctaggc

SEQ ID NO: 38188 - DNA, 16 bp, Artificial Sequence
  synthetic [barcode part1]
tgtaccacaacacgtg

SEQ ID NO: 38189 - DNA, 16 bp, Artificial Sequence
  synthetic [barcode part1]
attcgttagtaccacc

SEQ ID NO: 38190 - DNA, 16 bp, Artificial Sequence
  synthetic [barcode part1]
cgtgtatcttctctcg

SEQ ID NO: 38191 - DNA, 16 bp, Artificial Sequence
  synthetic [barcode part1]
cgtgattgttaaggag

SEQ ID NO: 38192 - DNA, 16 bp, Artificial Sequence
  synthetic [barcode part1]
ttggtccagtgtgtcc

SEQ ID NO: 38193 - DNA, 16 bp, Artificial Sequence
  synthetic [barcode part1]
ttggttggtacacacg

SEQ ID NO: 38194 - DNA, 16 bp, Artificial Sequence
  synthetic [barcode part1]
gccgaggttaatcttg

SEQ ID NO: 38195 - DNA, 16 bp, Artificial Sequence
  synthetic [barcode part1]
gttcacttcgtccgtt

SEQ ID NO: 38196 - DNA, 16 bp, Artificial Sequence
  synthetic [barcode part1]
tgttcgacctctgacg

SEQ ID NO: 38197 - DNA, 16 bp, Artificial Sequence
  synthetic [barcode part1]
agactcggtccaagtt

SEQ ID NO: 38198 - DNA, 16 bp, Artificial Sequence
  synthetic [barcode part1]
agtctccttctcagtc

SEQ ID NO: 38199 - DNA, 16 bp, Artificial Sequence
  synthetic [barcode part1]
gtgtgacaattgaggt

SEQ ID NO: 38200 - DNA, 16 bp, Artificial Sequence
  synthetic [barcode part1]
ataagaggtcgtcggc

SEQ ID NO: 38201 - DNA, 16 bp, Artificial Sequence
  synthetic [barcode part1]
ttctgcggaagtgtac

SEQ ID NO: 38202 - DNA, 16 bp, Artificial Sequence
  synthetic [barcode part1]
aacgttaaccgcggtt

SEQ ID NO: 38203 - DNA, 16 bp, Artificial Sequence
  synthetic [barcode part1]
gatcggtaaggtcctt

SEQ ID NO: 38204 - DNA, 16 bp, Artificial Sequence
  synthetic [barcode part1]
tggtgccaatagatag

SEQ ID NO: 38205 - DNA, 16 bp, Artificial Sequence
  synthetic [barcode part1]
cctcgacagagattgt

SEQ ID NO: 38206 - DNA, 16 bp, Artificial Sequence
  synthetic [barcode part1]
gtctcgttccaacttc

SEQ ID NO: 38207 - DNA, 16 bp, Artificial Sequence
  synthetic [barcode part1]
tccgtgttcagtaatc

SEQ ID NO: 38208 - DNA, 16 bp, Artificial Sequence
  synthetic [barcode part1]
accgttagattgccag

SEQ ID NO: 38209 - DNA, 16 bp, Artificial Sequence
  synthetic [barcode part1]
cgcaggccgttatctt

SEQ ID NO: 38210 - DNA, 16 bp, Artificial Sequence
  synthetic [barcode part1]
tagtgacacacagaac

SEQ ID NO: 38211 - DNA, 16 bp, Artificial Sequence
  synthetic [barcode part1]
ttggtgactatcggac

SEQ ID NO: 38212 - DNA, 16 bp, Artificial Sequence
  synthetic [barcode part1]
caccgtgaactgattg

SEQ ID NO: 38213 - DNA, 16 bp, Artificial Sequence
  synthetic [barcode part1]
tccgtaagttcacgag

SEQ ID NO: 38214 - DNA, 16 bp, Artificial Sequence
  synthetic [barcode part1]
actacttattcgcgac

SEQ ID NO: 38215 - DNA, 16 bp, Artificial Sequence
  synthetic [barcode part1]
aacagtaactccgtcg

SEQ ID NO: 38216 - DNA, 16 bp, Artificial Sequence
  synthetic [barcode part1]
tggaaggatcagtatc

SEQ ID NO: 38217 - DNA, 16 bp, Artificial Sequence
  synthetic [barcode part1]
aggtgacggttacacg

SEQ ID NO: 38218 - DNA, 16 bp, Artificial Sequence
  synthetic [barcode part1]
cgacgacgaaggtatc

SEQ ID NO: 38219 - DNA, 16 bp, Artificial Sequence
  synthetic [barcode part1]
ttcctgacacagttgt

SEQ ID NO: 38220 - DNA, 16 bp, Artificial Sequence
  synthetic [barcode part1]
gagactctacctatct

SEQ ID NO: 38221 - DNA, 16 bp, Artificial Sequence
  synthetic [barcode part1]
agagttaagaggccag

SEQ ID NO: 38222 - DNA, 16 bp, Artificial Sequence
  synthetic [barcode part1]
gacgtcgtaacgttac

SEQ ID NO: 38223 - DNA, 16 bp, Artificial Sequence
  synthetic [barcode part1]
agtcagttggtcaacc

SEQ ID NO: 38224 - DNA, 16 bp, Artificial Sequence
  synthetic [barcode part1]
agagtggtctgttacc

SEQ ID NO: 38225 - DNA, 16 bp, Artificial Sequence
  synthetic [barcode part1]
cgcctcgaatacctac

SEQ ID NO: 38226 - DNA, 16 bp, Artificial Sequence
  synthetic [barcode part1]
gactggaccacacaag

SEQ ID NO: 38227 - DNA, 16 bp, Artificial Sequence
  synthetic [barcode part1]
atcaacaggtgacagt

SEQ ID NO: 38228 - DNA, 16 bp, Artificial Sequence
  synthetic [barcode part1]
caagttgcgcgttctc

SEQ ID NO: 38229 - DNA, 16 bp, Artificial Sequence
  synthetic [barcode part1]
gcacacgaacttcaac

SEQ ID NO: 38230 - DNA, 16 bp, Artificial Sequence
  synthetic [barcode part1]
tgacttcaggatcggt

SEQ ID NO: 38231 - DNA, 16 bp, Artificial Sequence
  synthetic [barcode part1]
ttagatataccgcctc

SEQ ID NO: 38232 - DNA, 16 bp, Artificial Sequence
  synthetic [barcode part1]
aacgccactaaccagt

SEQ ID NO: 38233 - DNA, 16 bp, Artificial Sequence
  synthetic [barcode part1]
agacttatccgcaggt

SEQ ID NO: 38234 - DNA, 16 bp, Artificial Sequence
  synthetic [barcode part1]
gcagaagtaacggtcc

SEQ ID NO: 38235 - DNA, 16 bp, Artificial Sequence
  synthetic [barcode part1]
ttaagagtggcggaag

SEQ ID NO: 38236 - DNA, 16 bp, Artificial Sequence
  synthetic [barcode part1]
accgattcttctcctg

SEQ ID NO: 38237 - DNA, 16 bp, Artificial Sequence
  synthetic [barcode part1]
atacctcactgagtct

SEQ ID NO: 38238 - DNA, 16 bp, Artificial Sequence
  synthetic [barcode part1]
gcagacaatcttagag

SEQ ID NO: 38239 - DNA, 16 bp, Artificial Sequence
  synthetic [barcode part1]
tccggcaactcttacg

SEQ ID NO: 38240 - DNA, 16 bp, Artificial Sequence
  synthetic [barcode part1]
agacggtaactgcgtg

SEQ ID NO: 38241 - DNA, 16 bp, Artificial Sequence
  synthetic [barcode part1]
gagtatcgacactcac

SEQ ID NO: 38242 - DNA, 16 bp, Artificial Sequence
  synthetic [barcode part1]
ttcgccggtacttggt

SEQ ID NO: 38243 - DNA, 16 bp, Artificial Sequence
  synthetic [barcode part1]
tagattgtcggcgact

SEQ ID NO: 38244 - DNA, 16 bp, Artificial Sequence
  synthetic [barcode part1]
aggtccaggaccaagt

SEQ ID NO: 38245 - DNA, 16 bp, Artificial Sequence
  synthetic [barcode part1]
ttaggtgcaggataac

SEQ ID NO: 38246 - DNA, 16 bp, Artificial Sequence
  synthetic [barcode part1]
gttaacggtagaacac

SEQ ID NO: 38247 - DNA, 16 bp, Artificial Sequence
  synthetic [barcode part1]
ttcaataggcgatccg

SEQ ID NO: 38248 - DNA, 16 bp, Artificial Sequence
  synthetic [barcode part1]
aactcaggtgtgaggc

SEQ ID NO: 38249 - DNA, 16 bp, Artificial Sequence
  synthetic [barcode part1]
gagtactctataggcc

SEQ ID NO: 38250 - DNA, 16 bp, Artificial Sequence
  synthetic [barcode part1]
tatctcagacggaacc

SEQ ID NO: 38251 - DNA, 16 bp, Artificial Sequence
  synthetic [barcode part1]
ttggcaggaatcacct

SEQ ID NO: 38252 - DNA, 16 bp, Artificial Sequence
  synthetic [barcode part1]
tcgtcggactattgag

SEQ ID NO: 38253 - DNA, 16 bp, Artificial Sequence
  synthetic [barcode part1]
aacaagaaccagaggc

SEQ ID NO: 38254 - DNA, 16 bp, Artificial Sequence
  synthetic [barcode part1]
atacctcgaggacgtt

SEQ ID NO: 38255 - DNA, 16 bp, Artificial Sequence
  synthetic [barcode part1]
gcgagaggtataaggt

SEQ ID NO: 38256 - DNA, 16 bp, Artificial Sequence
  synthetic [barcode part1]
acaggaggatcgtcac

SEQ ID NO: 38257 - DNA, 16 bp, Artificial Sequence
  synthetic [barcode part1]
tcaatctctgccactc

SEQ ID NO: 38258 - DNA, 16 bp, Artificial Sequence
  synthetic [barcode part1]
gtacgacggtccttct

SEQ ID NO: 38259 - DNA, 16 bp, Artificial Sequence
  synthetic [barcode part1]
gatccggattatcgac

SEQ ID NO: 38260 - DNA, 16 bp, Artificial Sequence
  synthetic [barcode part1]
ttgcaccgtgagaatc

SEQ ID NO: 38261 - DNA, 16 bp, Artificial Sequence
  synthetic [barcode part1]
atccgttacaacacct

SEQ ID NO: 38262 - DNA, 16 bp, Artificial Sequence
  synthetic [barcode part1]
cgtactaaccgatacg

SEQ ID NO: 38263 - DNA, 16 bp, Artificial Sequence
  synthetic [barcode part1]
tgtctaggcgcaattg

SEQ ID NO: 38264 - DNA, 16 bp, Artificial Sequence
  synthetic [barcode part1]
gagtatcgacaggacc

SEQ ID NO: 38265 - DNA, 16 bp, Artificial Sequence
  synthetic [barcode part1]
cggattactagatcgc

SEQ ID NO: 38266 - DNA, 16 bp, Artificial Sequence
  synthetic [barcode part1]
ttgacgtgtgtaccag

SEQ ID NO: 38267 - DNA, 16 bp, Artificial Sequence
  synthetic [barcode part1]
gactcgacctcacact

SEQ ID NO: 38268 - DNA, 16 bp, Artificial Sequence
  synthetic [barcode part1]
gttccaagactctgag

SEQ ID NO: 38269 - DNA, 16 bp, Artificial Sequence
  synthetic [barcode part1]
ccttgacgtactcgac

SEQ ID NO: 38270 - DNA, 16 bp, Artificial Sequence
  synthetic [barcode part1]
gattcgaacactcttc

SEQ ID NO: 38271 - DNA, 16 bp, Artificial Sequence
  synthetic [barcode part1]
actacgtaaccacgtg

SEQ ID NO: 38272 - DNA, 16 bp, Artificial Sequence
  synthetic [barcode part1]
gcctctaatctgacgc

SEQ ID NO: 38273 - DNA, 16 bp, Artificial Sequence
  synthetic [barcode part1]
gcactgcgacaagtag

SEQ ID NO: 38274 - DNA, 16 bp, Artificial Sequence
  synthetic [barcode part1]
tacttgcagtaccact

SEQ ID NO: 38275 - DNA, 16 bp, Artificial Sequence
  synthetic [barcode part1]
ttacgcacacgtaacg

SEQ ID NO: 38276 - DNA, 16 bp, Artificial Sequence
  synthetic [barcode part1]
gcgcaatattgcgtgt

SEQ ID NO: 38277 - DNA, 16 bp, Artificial Sequence
  synthetic [barcode part1]
actgaggttctgatcg

SEQ ID NO: 38278 - DNA, 16 bp, Artificial Sequence
  synthetic [barcode part1]
acagactaagacaacc

SEQ ID NO: 38279 - DNA, 16 bp, Artificial Sequence
  synthetic [barcode part1]
tctacttggatcctag

SEQ ID NO: 38280 - DNA, 16 bp, Artificial Sequence
  synthetic [barcode part1]
caacgtacgattcttc

SEQ ID NO: 38281 - DNA, 16 bp, Artificial Sequence
  synthetic [barcode part1]
actatataaccgcgcg

SEQ ID NO: 38282 - DNA, 16 bp, Artificial Sequence
  synthetic [barcode part1]
acttcttactgtgcag

SEQ ID NO: 38283 - DNA, 16 bp, Artificial Sequence
  synthetic [barcode part1]
gtgttcaagactcacg

SEQ ID NO: 38284 - DNA, 16 bp, Artificial Sequence
  synthetic [barcode part1]
ccgaagttaccgtagt

SEQ ID NO: 38285 - DNA, 16 bp, Artificial Sequence
  synthetic [barcode part1]
ataaccgttagtcctc

SEQ ID NO: 38286 - DNA, 16 bp, Artificial Sequence
  synthetic [barcode part1]
caccaccgagtactct

SEQ ID NO: 38287 - DNA, 16 bp, Artificial Sequence
  synthetic [barcode part1]
actaggtcgtcagatc

SEQ ID NO: 38288 - DNA, 16 bp, Artificial Sequence
  synthetic [barcode part1]
atcaagagtacgtcag

SEQ ID NO: 38289 - DNA, 16 bp, Artificial Sequence
  synthetic [barcode part1]
ttccacaatcgccggt

SEQ ID NO: 38290 - DNA, 16 bp, Artificial Sequence
  synthetic [barcode part1]
ttgtgtgtggtgtgtg

SEQ ID NO: 38291 - DNA, 16 bp, Artificial Sequence
  synthetic [barcode part1]
tcaggaggtgtagtcg

SEQ ID NO: 38292 - DNA, 16 bp, Artificial Sequence
  synthetic [barcode part1]
gagatccgacgttgtt

SEQ ID NO: 38293 - DNA, 16 bp, Artificial Sequence
  synthetic [barcode part1]
attagagtgcgcggtg

SEQ ID NO: 38294 - DNA, 16 bp, Artificial Sequence
  synthetic [barcode part1]
acgcgaacttataccg

SEQ ID NO: 38295 - DNA, 16 bp, Artificial Sequence
  synthetic [barcode part1]
aattggcgattggtcc

SEQ ID NO: 38296 - DNA, 16 bp, Artificial Sequence
  synthetic [barcode part1]
agtgtaccagtacacc

SEQ ID NO: 38297 - DNA, 16 bp, Artificial Sequence
  synthetic [barcode part1]
accttgcgttccttac

SEQ ID NO: 38298 - DNA, 16 bp, Artificial Sequence
  synthetic [barcode part1]
acacagttggtgtacc

SEQ ID NO: 38299 - DNA, 16 bp, Artificial Sequence
  synthetic [barcode part1]
aacctccacgtgactc

SEQ ID NO: 38300 - DNA, 16 bp, Artificial Sequence
  synthetic [barcode part1]
gtgtcaacttcgttac

SEQ ID NO: 38301 - DNA, 16 bp, Artificial Sequence
  synthetic [barcode part1]
tcctcggttgatctct

SEQ ID NO: 38302 - DNA, 16 bp, Artificial Sequence
  synthetic [barcode part1]
tggatcttactgtctg

SEQ ID NO: 38303 - DNA, 16 bp, Artificial Sequence
  synthetic [barcode part1]
cactgagttacgtctt

SEQ ID NO: 38304 - DNA, 16 bp, Artificial Sequence
  synthetic [barcode part1]
gtaagagtaacgacct

SEQ ID NO: 38305 - DNA, 16 bp, Artificial Sequence
  synthetic [barcode part1]
acctatcaggtcttgt

SEQ ID NO: 38306 - DNA, 16 bp, Artificial Sequence
  synthetic [barcode part1]
aaggttcgtaagtgac

SEQ ID NO: 38307 - DNA, 16 bp, Artificial Sequence
  synthetic [barcode part1]
caggccactaataacc

SEQ ID NO: 38308 - DNA, 16 bp, Artificial Sequence
  synthetic [barcode part1]
tcaagtgaacggaatc

SEQ ID NO: 38309 - DNA, 16 bp, Artificial Sequence
  synthetic [barcode part1]
gatccaggattcggtt

SEQ ID NO: 38310 - DNA, 16 bp, Artificial Sequence
  synthetic [barcode part1]
aactcgacacagaggc

SEQ ID NO: 38311 - DNA, 16 bp, Artificial Sequence
  synthetic [barcode part1]
agtatcggtgtcgtac

SEQ ID NO: 38312 - DNA, 16 bp, Artificial Sequence
  synthetic [barcode part1]
cgtcggttagtatacg

SEQ ID NO: 38313 - DNA, 16 bp, Artificial Sequence
  synthetic [barcode part1]
acggttacaattgcgc

SEQ ID NO: 38314 - DNA, 16 bp, Artificial Sequence
  synthetic [barcode part1]
cggaaggcaatcgtgt

SEQ ID NO: 38315 - DNA, 16 bp, Artificial Sequence
  synthetic [barcode part1]
gatctacgtcttatcg

SEQ ID NO: 38316 - DNA, 16 bp, Artificial Sequence
  synthetic [barcode part1]
ccggtaacgttctcgt

SEQ ID NO: 38317 - DNA, 16 bp, Artificial Sequence
  synthetic [barcode part1]
tcagtcagatcggttg

SEQ ID NO: 38318 - DNA, 16 bp, Artificial Sequence
  synthetic [barcode part1]
tcaacacctagttctg

SEQ ID NO: 38319 - DNA, 16 bp, Artificial Sequence
  synthetic [barcode part1]
taatcgcagtgcactg

SEQ ID NO: 38320 - DNA, 16 bp, Artificial Sequence
  synthetic [barcode part1]
aatcctggcctactcg

SEQ ID NO: 38321 - DNA, 16 bp, Artificial Sequence
  synthetic [barcode part1]
aagtgagtccgaagtt

SEQ ID NO: 38322 - DNA, 16 bp, Artificial Sequence
  synthetic [barcode part1]
gtatacgtgcaacacc

SEQ ID NO: 38323 - DNA, 16 bp, Artificial Sequence
  synthetic [barcode part1]
tagacgtctagtacgc

SEQ ID NO: 38324 - DNA, 16 bp, Artificial Sequence
  synthetic [barcode part1]
acaaggataacctggt

SEQ ID NO: 38325 - DNA, 16 bp, Artificial Sequence
  synthetic [barcode part1]
gatacaacgagtcgcg

SEQ ID NO: 38326 - DNA, 16 bp, Artificial Sequence
  synthetic [barcode part1]
tgtgcaaggatacctc

SEQ ID NO: 38327 - DNA, 16 bp, Artificial Sequence
  synthetic [barcode part1]
tcgttgtattcgtggt

SEQ ID NO: 38328 - DNA, 16 bp, Artificial Sequence
  synthetic [barcode part1]
aataatctctcgcacc

SEQ ID NO: 38329 - DNA, 16 bp, Artificial Sequence
  synthetic [barcode part1]
acaacactgactgacc

SEQ ID NO: 38330 - DNA, 16 bp, Artificial Sequence
  synthetic [barcode part1]
tatagatctcaccacc

SEQ ID NO: 38331 - DNA, 16 bp, Artificial Sequence
  synthetic [barcode part1]
gtagaagtagtgacct

SEQ ID NO: 38332 - DNA, 16 bp, Artificial Sequence
  synthetic [barcode part1]
aaccttgataggcaag

SEQ ID NO: 38333 - DNA, 16 bp, Artificial Sequence
  synthetic [barcode part1]
agagaagtagttggcg

SEQ ID NO: 38334 - DNA, 16 bp, Artificial Sequence
  synthetic [barcode part1]
accaggtccgtgtctt

SEQ ID NO: 38335 - DNA, 16 bp, Artificial Sequence
  synthetic [barcode part1]
agagtattcggtggcg

SEQ ID NO: 38336 - DNA, 16 bp, Artificial Sequence
  synthetic [barcode part1]
tcgtccacttgtctac

SEQ ID NO: 38337 - DNA, 16 bp, Artificial Sequence
  synthetic [barcode part1]
atccgtcttcacctac

SEQ ID NO: 38338 - DNA, 16 bp, Artificial Sequence
  synthetic [barcode part1]
tagagttgcactgcgt

SEQ ID NO: 38339 - DNA, 16 bp, Artificial Sequence
  synthetic [barcode part1]
tgttaggtcgcgtctc

SEQ ID NO: 38340 - DNA, 16 bp, Artificial Sequence
  synthetic [barcode part1]
taccgcgtaatcaacg

SEQ ID NO: 38341 - DNA, 16 bp, Artificial Sequence
  synthetic [barcode part1]
gaacgtccttatcgtt

SEQ ID NO: 38342 - DNA, 16 bp, Artificial Sequence
  synthetic [barcode part1]
agaggtctcaattccg

SEQ ID NO: 38343 - DNA, 16 bp, Artificial Sequence
  synthetic [barcode part1]
tccagaggagattcct

SEQ ID NO: 38344 - DNA, 16 bp, Artificial Sequence
  synthetic [barcode part1]
gcaactatctcaactc

SEQ ID NO: 38345 - DNA, 16 bp, Artificial Sequence
  synthetic [barcode part1]
cgatatctatctaccg

SEQ ID NO: 38346 - DNA, 16 bp, Artificial Sequence
  synthetic [barcode part1]
cggtggcgagagtatt

SEQ ID NO: 38347 - DNA, 16 bp, Artificial Sequence
  synthetic [barcode part1]
gaccagtgatcctagt

SEQ ID NO: 38348 - DNA, 16 bp, Artificial Sequence
  synthetic [barcode part1]
cacctcaggacttacc

SEQ ID NO: 38349 - DNA, 16 bp, Artificial Sequence
  synthetic [barcode part1]
gtgtgttaggtgtctg

SEQ ID NO: 38350 - DNA, 16 bp, Artificial Sequence
  synthetic [barcode part1]
gactcggttagtaacc

SEQ ID NO: 38351 - DNA, 16 bp, Artificial Sequence
  synthetic [barcode part1]
cgccttgagatagtgt

SEQ ID NO: 38352 - DNA, 16 bp, Artificial Sequence
  synthetic [barcode part1]
gacaactagttcggtc

SEQ ID NO: 38353 - DNA, 16 bp, Artificial Sequence
  synthetic [barcode part1]
ttgatctgtcctccac

SEQ ID NO: 38354 - DNA, 16 bp, Artificial Sequence
  synthetic [barcode part1]
tcgttgttaggacggt

SEQ ID NO: 38355 - DNA, 16 bp, Artificial Sequence
  synthetic [barcode part1]
aatcacgaatcaggac

SEQ ID NO: 38356 - DNA, 16 bp, Artificial Sequence
  synthetic [barcode part1]
tacgccgtaattgcag

SEQ ID NO: 38357 - DNA, 16 bp, Artificial Sequence
  synthetic [barcode part1]
tgcgtgagaaccgagt

SEQ ID NO: 38358 - DNA, 16 bp, Artificial Sequence
  synthetic [barcode part1]
aacacctctacgtgag

SEQ ID NO: 38359 - DNA, 16 bp, Artificial Sequence
  synthetic [barcode part1]
ttatacaccagaggag

SEQ ID NO: 38360 - DNA, 16 bp, Artificial Sequence
  synthetic [barcode part1]
ttgtgagacgaagtac

SEQ ID NO: 38361 - DNA, 16 bp, Artificial Sequence
  synthetic [barcode part1]
ttcgaacacttggacg

SEQ ID NO: 38362 - DNA, 16 bp, Artificial Sequence
  synthetic [barcode part1]
tgtacaggtaggacgc

SEQ ID NO: 38363 - DNA, 16 bp, Artificial Sequence
  synthetic [barcode part1]
taggttcgtaagtccg

SEQ ID NO: 38364 - DNA, 16 bp, Artificial Sequence
  synthetic [barcode part1]
gcagtgaacgaagtag

SEQ ID NO: 38365 - DNA, 16 bp, Artificial Sequence
  synthetic [barcode part1]
tactcacggacgagtt

SEQ ID NO: 38366 - DNA, 16 bp, Artificial Sequence
  synthetic [barcode part1]
caccaccttgttgtct

SEQ ID NO: 38367 - DNA, 16 bp, Artificial Sequence
  synthetic [barcode part1]
gaacaggactccgaac

SEQ ID NO: 38368 - DNA, 16 bp, Artificial Sequence
  synthetic [barcode part1]
agttgaaggacgtccg

SEQ ID NO: 38369 - DNA, 16 bp, Artificial Sequence
  synthetic [barcode part1]
gacagttgtcgttgac

SEQ ID NO: 38370 - DNA, 16 bp, Artificial Sequence
  synthetic [barcode part1]
ccagtctgtctcttac

SEQ ID NO: 38371 - DNA, 16 bp, Artificial Sequence
  synthetic [barcode part1]
cggacgttcttcaacc

SEQ ID NO: 38372 - DNA, 16 bp, Artificial Sequence
  synthetic [barcode part1]
ataacgtgtaccgcgt

SEQ ID NO: 38373 - DNA, 16 bp, Artificial Sequence
  synthetic [barcode part1]
gttagtcaaccgactg

SEQ ID NO: 38374 - DNA, 16 bp, Artificial Sequence
  synthetic [barcode part1]
tctctcggacaacaag

SEQ ID NO: 38375 - DNA, 16 bp, Artificial Sequence
  synthetic [barcode part1]
tgttctatcgcggacc

SEQ ID NO: 38376 - DNA, 16 bp, Artificial Sequence
  synthetic [barcode part1]
tagtaagaagttcgcg

SEQ ID NO: 38377 - DNA, 16 bp, Artificial Sequence
  synthetic [barcode part1]
tgcagattaaggcaac

SEQ ID NO: 38378 - DNA, 16 bp, Artificial Sequence
  synthetic [barcode part1]
ttccttacctgtgaag

SEQ ID NO: 38379 - DNA, 16 bp, Artificial Sequence
  synthetic [barcode part1]
gttctcgtgttcttgc

SEQ ID NO: 38380 - DNA, 16 bp, Artificial Sequence
  synthetic [barcode part1]
tgttgagtccgtattc

SEQ ID NO: 38381 - DNA, 16 bp, Artificial Sequence
  synthetic [barcode part1]
gaacggtggaagttag

SEQ ID NO: 38382 - DNA, 16 bp, Artificial Sequence
  synthetic [barcode part1]
tcctgaagtctgtccg

SEQ ID NO: 38383 - DNA, 16 bp, Artificial Sequence
  synthetic [barcode part1]
tcactaccactcaagt

SEQ ID NO: 38384 - DNA, 16 bp, Artificial Sequence
  synthetic [barcode part1]
caataatccggcaacc

SEQ ID NO: 38385 - DNA, 16 bp, Artificial Sequence
  synthetic [barcode part1]
cgtaggactctatacg

SEQ ID NO: 38386 - DNA, 16 bp, Artificial Sequence
  synthetic [barcode part1]
gacttgtcagagtaag

SEQ ID NO: 38387 - DNA, 16 bp, Artificial Sequence
  synthetic [barcode part1]
cacctcgtgttatcct

SEQ ID NO: 38388 - DNA, 16 bp, Artificial Sequence
  synthetic [barcode part1]
tgaatcagaccgtcgt

SEQ ID NO: 38389 - DNA, 16 bp, Artificial Sequence
  synthetic [barcode part1]
acacaggtccaacgag

SEQ ID NO: 38390 - DNA, 16 bp, Artificial Sequence
  synthetic [barcode part1]
tgatcggactagtcgt

SEQ ID NO: 38391 - DNA, 16 bp, Artificial Sequence
  synthetic [barcode part1]
ttcgacctgatacgcc

SEQ ID NO: 38392 - DNA, 16 bp, Artificial Sequence
  synthetic [barcode part1]
gcgcactggcaataag

SEQ ID NO: 38393 - DNA, 16 bp, Artificial Sequence
  synthetic [barcode part1]
tatccgcgatactgcc

SEQ ID NO: 38394 - DNA, 16 bp, Artificial Sequence
  synthetic [barcode part1]
tggcgtagtacttggt

SEQ ID NO: 38395 - DNA, 16 bp, Artificial Sequence
  synthetic [barcode part1]
tcaggaccgagtaggt

SEQ ID NO: 38396 - DNA, 16 bp, Artificial Sequence
  synthetic [barcode part1]
tgattgccgttccgtg

SEQ ID NO: 38397 - DNA, 16 bp, Artificial Sequence
  synthetic [barcode part1]
acttcaccttgcaagt

SEQ ID NO: 38398 - DNA, 16 bp, Artificial Sequence
  synthetic [barcode part1]
gccggtgaagttaggt

SEQ ID NO: 38399 - DNA, 16 bp, Artificial Sequence
  synthetic [barcode part1]
taggtacctagtacgc

SEQ ID NO: 38400 - DNA, 16 bp, Artificial Sequence
  synthetic [barcode part1]
actgcagtgaagtcct

SEQ ID NO: 38401 - DNA, 16 bp, Artificial Sequence
  synthetic [barcode part1]
actgactaaccaaccg

SEQ ID NO: 38402 - DNA, 16 bp, Artificial Sequence
  synthetic [barcode part1]
ataccaacaacgaggt

SEQ ID NO: 38403 - DNA, 16 bp, Artificial Sequence
  synthetic [barcode part1]
tgatcactacctcgcg

SEQ ID NO: 38404 - DNA, 16 bp, Artificial Sequence
  synthetic [barcode part1]
tgaacgtgatcgtacc

SEQ ID NO: 38405 - DNA, 16 bp, Artificial Sequence
  synthetic [barcode part1]
gatctggactagacct

SEQ ID NO: 38406 - DNA, 16 bp, Artificial Sequence
  synthetic [barcode part1]
caacacgactaagagt

SEQ ID NO: 38407 - DNA, 16 bp, Artificial Sequence
  synthetic [barcode part1]
tcagacactgcagatc

SEQ ID NO: 38408 - DNA, 16 bp, Artificial Sequence
  synthetic [barcode part1]
aggtattccgcctcgt

SEQ ID NO: 38409 - DNA, 16 bp, Artificial Sequence
  synthetic [barcode part1]
aaccacacgtacgatc

SEQ ID NO: 38410 - DNA, 16 bp, Artificial Sequence
  synthetic [barcode part1]
tgtcgtcgcctgaatc

SEQ ID NO: 38411 - DNA, 16 bp, Artificial Sequence
  synthetic [barcode part1]
acacaacgtacgtcac

SEQ ID NO: 38412 - DNA, 16 bp, Artificial Sequence
  synthetic [barcode part1]
ttggtaaggcacaagt

SEQ ID NO: 38413 - DNA, 16 bp, Artificial Sequence
  synthetic [barcode part1]
tacctgttcgtccact

SEQ ID NO: 38414 - DNA, 16 bp, Artificial Sequence
  synthetic [barcode part1]
atactcctgacctagt

SEQ ID NO: 38415 - DNA, 16 bp, Artificial Sequence
  synthetic [barcode part1]
cctctaactggtcctt

SEQ ID NO: 38416 - DNA, 16 bp, Artificial Sequence
  synthetic [barcode part1]
gtgtatcgtgactacg

SEQ ID NO: 38417 - DNA, 16 bp, Artificial Sequence
  synthetic [barcode part1]
acactcacgagtatcg

SEQ ID NO: 38418 - DNA, 16 bp, Artificial Sequence
  synthetic [barcode part1]
taggaccgattccagt

SEQ ID NO: 38419 - DNA, 16 bp, Artificial Sequence
  synthetic [barcode part1]
ttcagagtgtacacgc

SEQ ID NO: 38420 - DNA, 16 bp, Artificial Sequence
  synthetic [barcode part1]
agtgtacctccgatcc

SEQ ID NO: 38421 - DNA, 16 bp, Artificial Sequence
  synthetic [barcode part1]
atacaacctgactcct

SEQ ID NO: 38422 - DNA, 16 bp, Artificial Sequence
  synthetic [barcode part1]
tgcctctctctatacg

SEQ ID NO: 38423 - DNA, 16 bp, Artificial Sequence
  synthetic [barcode part1]
acgaattcgcggactt

SEQ ID NO: 38424 - DNA, 16 bp, Artificial Sequence
  synthetic [barcode part1]
cgagacctagtcaatc

SEQ ID NO: 38425 - DNA, 16 bp, Artificial Sequence
  synthetic [barcode part1]
caacaactgacctgac

SEQ ID NO: 38426 - DNA, 16 bp, Artificial Sequence
  synthetic [barcode part1]
gcggtacagaattctc

SEQ ID NO: 38427 - DNA, 16 bp, Artificial Sequence
  synthetic [barcode part1]
gccacggttgcctatt

SEQ ID NO: 38428 - DNA, 16 bp, Artificial Sequence
  synthetic [barcode part1]
cgcgtccttgttagac

SEQ ID NO: 38429 - DNA, 16 bp, Artificial Sequence
  synthetic [barcode part1]
taccaacggttagaag

SEQ ID NO: 38430 - DNA, 16 bp, Artificial Sequence
  synthetic [barcode part1]
caaccaacgtagtacc

SEQ ID NO: 38431 - DNA, 16 bp, Artificial Sequence
  synthetic [barcode part1]
acagtacactgaccac

SEQ ID NO: 38432 - DNA, 16 bp, Artificial Sequence
  synthetic [barcode part1]
agtaagtacaacaccg

SEQ ID NO: 38433 - DNA, 16 bp, Artificial Sequence
  synthetic [barcode part1]
aggtgacactgaagag

SEQ ID NO: 38434 - DNA, 16 bp, Artificial Sequence
  synthetic [barcode part1]
cggttcgtcgtattcg

SEQ ID NO: 38435 - DNA, 16 bp, Artificial Sequence
  synthetic [barcode part1]
taataacgcgtgagac

SEQ ID NO: 38436 - DNA, 16 bp, Artificial Sequence
  synthetic [barcode part1]
aattgcctccgcactg

SEQ ID NO: 38437 - DNA, 16 bp, Artificial Sequence
  synthetic [barcode part1]
taagtgcgtcggagac

SEQ ID NO: 38438 - DNA, 16 bp, Artificial Sequence
  synthetic [barcode part1]
caccttcgattcgacg

SEQ ID NO: 38439 - DNA, 16 bp, Artificial Sequence
  synthetic [barcode part1]
gtgtcgacacagactt

SEQ ID NO: 38440 - DNA, 16 bp, Artificial Sequence
  synthetic [barcode part1]
tcgtgataggacttcg

SEQ ID NO: 38441 - DNA, 16 bp, Artificial Sequence
  synthetic [barcode part1]
tatcaataaggccgag

SEQ ID NO: 38442 - DNA, 16 bp, Artificial Sequence
  synthetic [barcode part1]
aacacggaacagtccg

SEQ ID NO: 38443 - DNA, 16 bp, Artificial Sequence
  synthetic [barcode part1]
cgatcctgtatactac

SEQ ID NO: 38444 - DNA, 16 bp, Artificial Sequence
  synthetic [barcode part1]
tgcggtaacgagtggt

SEQ ID NO: 38445 - DNA, 16 bp, Artificial Sequence
  synthetic [barcode part1]
atcggagtgcacaacg

SEQ ID NO: 38446 - DNA, 16 bp, Artificial Sequence
  synthetic [barcode part1]
acgagacttcagatag

SEQ ID NO: 38447 - DNA, 16 bp, Artificial Sequence
  synthetic [barcode part1]
cacttactggaacctt

SEQ ID NO: 38448 - DNA, 16 bp, Artificial Sequence
  synthetic [barcode part1]
aatcacgtgcgcaatc

SEQ ID NO: 38449 - DNA, 16 bp, Artificial Sequence
  synthetic [barcode part1]
accgagtatctctgtt

SEQ ID NO: 38450 - DNA, 16 bp, Artificial Sequence
  synthetic [barcode part1]
agacggtaaggtaacg

SEQ ID NO: 38451 - DNA, 16 bp, Artificial Sequence
  synthetic [barcode part1]
tcgaccttaccaacgc

SEQ ID NO: 38452 - DNA, 16 bp, Artificial Sequence
  synthetic [barcode part1]
tgcgaatactcgtgac

SEQ ID NO: 38453 - DNA, 16 bp, Artificial Sequence
  synthetic [barcode part1]
agattcgatccttcac

SEQ ID NO: 38454 - DNA, 16 bp, Artificial Sequence
  synthetic [barcode part1]
acttcgttgaatccgt

SEQ ID NO: 38455 - DNA, 16 bp, Artificial Sequence
  synthetic [barcode part1]
aggtcagtgacacgtg

SEQ ID NO: 38456 - DNA, 16 bp, Artificial Sequence
  synthetic [barcode part1]
gatatatcgcgatcgc

SEQ ID NO: 38457 - DNA, 16 bp, Artificial Sequence
  synthetic [barcode part1]
aagttgcgcgagaacc

SEQ ID NO: 38458 - DNA, 16 bp, Artificial Sequence
  synthetic [barcode part1]
gtgtgcaggagttctt

SEQ ID NO: 38459 - DNA, 16 bp, Artificial Sequence
  synthetic [barcode part1]
ttgaccacctcaagag

SEQ ID NO: 38460 - DNA, 16 bp, Artificial Sequence
  synthetic [barcode part1]
ccgtaatacgtacacg

SEQ ID NO: 38461 - DNA, 16 bp, Artificial Sequence
  synthetic [barcode part1]
actgacggtctgaact

SEQ ID NO: 38462 - DNA, 16 bp, Artificial Sequence
  synthetic [barcode part1]
gagttgcgcgagagtt

SEQ ID NO: 38463 - DNA, 16 bp, Artificial Sequence
  synthetic [barcode part1]
tgcacgacgaattcgt

SEQ ID NO: 38464 - DNA, 16 bp, Artificial Sequence
  synthetic [barcode part1]
aacctcacactacgag

SEQ ID NO: 38465 - DNA, 16 bp, Artificial Sequence
  synthetic [barcode part1]
tctggaggtcaactgt

SEQ ID NO: 38466 - DNA, 16 bp, Artificial Sequence
  synthetic [barcode part1]
actctccgttgacgtg

SEQ ID NO: 38467 - DNA, 16 bp, Artificial Sequence
  synthetic [barcode part1]
aggtctagagttgaac

SEQ ID NO: 38468 - DNA, 16 bp, Artificial Sequence
  synthetic [barcode part1]
tacgcctgtccaacac

SEQ ID NO: 38469 - DNA, 16 bp, Artificial Sequence
  synthetic [barcode part1]
tctccgagttaacgcc

SEQ ID NO: 38470 - DNA, 16 bp, Artificial Sequence
  synthetic [barcode part1]
gcagagagattcaatc

SEQ ID NO: 38471 - DNA, 16 bp, Artificial Sequence
  synthetic [barcode part1]
tgtgcctggatacaac

SEQ ID NO: 38472 - DNA, 16 bp, Artificial Sequence
  synthetic [barcode part1]
gtcagagattggcgtg

SEQ ID NO: 38473 - DNA, 16 bp, Artificial Sequence
  synthetic [barcode part1]
ttggtaacttgtgcct

SEQ ID NO: 38474 - DNA, 16 bp, Artificial Sequence
  synthetic [barcode part1]
agagtattggcggtcg

SEQ ID NO: 38475 - DNA, 16 bp, Artificial Sequence
  synthetic [barcode part1]
aatctggtccttacac

SEQ ID NO: 38476 - DNA, 16 bp, Artificial Sequence
  synthetic [barcode part1]
acgtcttccggtaatt

SEQ ID NO: 38477 - DNA, 16 bp, Artificial Sequence
  synthetic [barcode part1]
cgtgatacctaagacc

SEQ ID NO: 38478 - DNA, 16 bp, Artificial Sequence
  synthetic [barcode part1]
caacgtgaggataact

SEQ ID NO: 38479 - DNA, 16 bp, Artificial Sequence
  synthetic [barcode part1]
ccttcgaactgtgtgc

SEQ ID NO: 38480 - DNA, 16 bp, Artificial Sequence
  synthetic [barcode part1]
ccaactcagtacgtcc

SEQ ID NO: 38481 - DNA, 16 bp, Artificial Sequence
  synthetic [barcode part1]
cgcagtgttgtgatac

SEQ ID NO: 38482 - DNA, 16 bp, Artificial Sequence
  synthetic [barcode part1]
actctccaagaccaag

SEQ ID NO: 38483 - DNA, 16 bp, Artificial Sequence
  synthetic [barcode part1]
aacgaagatacctggt

SEQ ID NO: 38484 - DNA, 16 bp, Artificial Sequence
  synthetic [barcode part1]
cctctgttattagacg

SEQ ID NO: 38485 - DNA, 16 bp, Artificial Sequence
  synthetic [barcode part1]
gagttcagtgaagtac

SEQ ID NO: 38486 - DNA, 16 bp, Artificial Sequence
  synthetic [barcode part1]
ttggttccactggcgt

SEQ ID NO: 38487 - DNA, 16 bp, Artificial Sequence
  synthetic [barcode part1]
actcgatcagtccaag

SEQ ID NO: 38488 - DNA, 16 bp, Artificial Sequence
  synthetic [barcode part1]
actattcggtaggacc

SEQ ID NO: 38489 - DNA, 16 bp, Artificial Sequence
  synthetic [barcode part1]
acacggacctaacgag

SEQ ID NO: 38490 - DNA, 16 bp, Artificial Sequence
  synthetic [barcode part1]
agttcgatcagatcgc

SEQ ID NO: 38491 - DNA, 16 bp, Artificial Sequence
  synthetic [barcode part1]
gttctcgaataactcc

SEQ ID NO: 38492 - DNA, 16 bp, Artificial Sequence
  synthetic [barcode part1]
ttgccggttctcgtag

SEQ ID NO: 38493 - DNA, 16 bp, Artificial Sequence
  synthetic [barcode part1]
tcaacgagagtgtggc

SEQ ID NO: 38494 - DNA, 16 bp, Artificial Sequence
  synthetic [barcode part1]
tcgagaccgaacaggt

SEQ ID NO: 38495 - DNA, 16 bp, Artificial Sequence
  synthetic [barcode part1]
attacctggtggaacc

SEQ ID NO: 38496 - DNA, 16 bp, Artificial Sequence
  synthetic [barcode part1]
ttctgataccggagac

SEQ ID NO: 38497 - DNA, 16 bp, Artificial Sequence
  synthetic [barcode part1]
ttgcagaggatcggac

SEQ ID NO: 38498 - DNA, 16 bp, Artificial Sequence
  synthetic [barcode part1]
agaggcgttaccgagt

SEQ ID NO: 38499 - DNA, 16 bp, Artificial Sequence
  synthetic [barcode part1]
tacacgttgaccaacg

SEQ ID NO: 38500 - DNA, 16 bp, Artificial Sequence
  synthetic [barcode part1]
agtgaaggcgtggtct

SEQ ID NO: 38501 - DNA, 16 bp, Artificial Sequence
  synthetic [barcode part1]
ttagaaggcacagttg

SEQ ID NO: 38502 - DNA, 16 bp, Artificial Sequence
  synthetic [barcode part1]
tcgtcctcgtgaactg

SEQ ID NO: 38503 - DNA, 16 bp, Artificial Sequence
  synthetic [barcode part1]
gtcgaccgtattgtag

SEQ ID NO: 38504 - DNA, 16 bp, Artificial Sequence
  synthetic [barcode part1]
ttaccttcgtggaccg

SEQ ID NO: 38505 - DNA, 16 bp, Artificial Sequence
  synthetic [barcode part1]
tatctattcgcgacgt

SEQ ID NO: 38506 - DNA, 16 bp, Artificial Sequence
  synthetic [barcode part1]
ccgaatacaagtgtcc

SEQ ID NO: 38507 - DNA, 16 bp, Artificial Sequence
  synthetic [barcode part1]
acggttaccttctaac

SEQ ID NO: 38508 - DNA, 16 bp, Artificial Sequence
  synthetic [barcode part1]
acggagaccgaattgc

SEQ ID NO: 38509 - DNA, 16 bp, Artificial Sequence
  synthetic [barcode part1]
gttgtggaagtagact

SEQ ID NO: 38510 - DNA, 16 bp, Artificial Sequence
  synthetic [barcode part1]
acgtacttacttcgtg

SEQ ID NO: 38511 - DNA, 16 bp, Artificial Sequence
  synthetic [barcode part1]
gcaggaagattgccac

SEQ ID NO: 38512 - DNA, 16 bp, Artificial Sequence
  synthetic [barcode part1]
gttgaacacgaagatc

SEQ ID NO: 38513 - DNA, 16 bp, Artificial Sequence
  synthetic [barcode part1]
atcacggacctgcctt

SEQ ID NO: 38514 - DNA, 16 bp, Artificial Sequence
  synthetic [barcode part1]
caactccactgacgtc

SEQ ID NO: 38515 - DNA, 16 bp, Artificial Sequence
  synthetic [barcode part1]
gtcagactctagtggt

SEQ ID NO: 38516 - DNA, 16 bp, Artificial Sequence
  synthetic [barcode part1]
gtaggtcaaggtaact

SEQ ID NO: 38517 - DNA, 16 bp, Artificial Sequence
  synthetic [barcode part1]
agtacgcctggtctct

SEQ ID NO: 38518 - DNA, 16 bp, Artificial Sequence
  synthetic [barcode part1]
tcttcgcagacacaag

SEQ ID NO: 38519 - DNA, 16 bp, Artificial Sequence
  synthetic [barcode part1]
accgtctgtggacttc

SEQ ID NO: 38520 - DNA, 16 bp, Artificial Sequence
  synthetic [barcode part1]
gtatcttctagtggtc

SEQ ID NO: 38521 - DNA, 16 bp, Artificial Sequence
  synthetic [barcode part1]
atcgtccgtagtgaac

SEQ ID NO: 38522 - DNA, 16 bp, Artificial Sequence
  synthetic [barcode part1]
agtccgactaacggtt

SEQ ID NO: 38523 - DNA, 16 bp, Artificial Sequence
  synthetic [barcode part1]
aagatcaaccgccttg

SEQ ID NO: 38524 - DNA, 16 bp, Artificial Sequence
  synthetic [barcode part1]
tataccgccttaactg

SEQ ID NO: 38525 - DNA, 16 bp, Artificial Sequence
  synthetic [barcode part1]
agtgcacgtcggtatt

SEQ ID NO: 38526 - DNA, 16 bp, Artificial Sequence
  synthetic [barcode part1]
tgaactcggacgacag

SEQ ID NO: 38527 - DNA, 16 bp, Artificial Sequence
  synthetic [barcode part1]
tgccgagaacacagac

SEQ ID NO: 38528 - DNA, 16 bp, Artificial Sequence
  synthetic [barcode part1]
tgccgccgatatatcc

SEQ ID NO: 38529 - DNA, 16 bp, Artificial Sequence
  synthetic [barcode part1]
taccgattacgtggtg

SEQ ID NO: 38530 - DNA, 16 bp, Artificial Sequence
  synthetic [barcode part1]
cgagtcgaactcaatc

SEQ ID NO: 38531 - DNA, 16 bp, Artificial Sequence
  synthetic [barcode part1]
gtggcaagtccaagtg

SEQ ID NO: 38532 - DNA, 16 bp, Artificial Sequence
  synthetic [barcode part1]
aggtatactgacggcg

SEQ ID NO: 38533 - DNA, 16 bp, Artificial Sequence
  synthetic [barcode part1]
gtctcgtagtacgtcc

SEQ ID NO: 38534 - DNA, 16 bp, Artificial Sequence
  synthetic [barcode part1]
caagtcgtcctgcact

SEQ ID NO: 38535 - DNA, 16 bp, Artificial Sequence
  synthetic [barcode part1]
acggattacgcaatcc

SEQ ID NO: 38536 - DNA, 16 bp, Artificial Sequence
  synthetic [barcode part1]
ttcttacctcgtgtcg

SEQ ID NO: 38537 - DNA, 16 bp, Artificial Sequence
  synthetic [barcode part1]
ccaccgtacgaactct

SEQ ID NO: 38538 - DNA, 16 bp, Artificial Sequence
  synthetic [barcode part1]
aactgtgtgcaaccac

SEQ ID NO: 38539 - DNA, 16 bp, Artificial Sequence
  synthetic [barcode part1]
ttgaccaagaactccg

SEQ ID NO: 38540 - DNA, 16 bp, Artificial Sequence
  synthetic [barcode part1]
ttgcaggcgttccgtt

SEQ ID NO: 38541 - DNA, 16 bp, Artificial Sequence
  synthetic [barcode part1]
ccaggtgtagatactc

SEQ ID NO: 38542 - DNA, 16 bp, Artificial Sequence
  synthetic [barcode part1]
gttaacgccactattc

SEQ ID NO: 38543 - DNA, 16 bp, Artificial Sequence
  synthetic [barcode part1]
attgcgttaactcctg

SEQ ID NO: 38544 - DNA, 16 bp, Artificial Sequence
  synthetic [barcode part1]
aggagtacaggttgtt

SEQ ID NO: 38545 - DNA, 16 bp, Artificial Sequence
  synthetic [barcode part1]
atctcttgtcaacgtg

SEQ ID NO: 38546 - DNA, 16 bp, Artificial Sequence
  synthetic [barcode part1]
tgtggttcgattcttg

SEQ ID NO: 38547 - DNA, 16 bp, Artificial Sequence
  synthetic [barcode part1]
tacgatagacgccact

SEQ ID NO: 38548 - DNA, 16 bp, Artificial Sequence
  synthetic [barcode part1]
gcactataggtaggcg

SEQ ID NO: 38549 - DNA, 16 bp, Artificial Sequence
  synthetic [barcode part1]
atattagtcggtgcgc

SEQ ID NO: 38550 - DNA, 16 bp, Artificial Sequence
  synthetic [barcode part1]
gcggtggtaagtctag

SEQ ID NO: 38551 - DNA, 16 bp, Artificial Sequence
  synthetic [barcode part1]
gcctgtcgatactatt

SEQ ID NO: 38552 - DNA, 16 bp, Artificial Sequence
  synthetic [barcode part1]
tcaccgcgaatccgtt

SEQ ID NO: 38553 - DNA, 16 bp, Artificial Sequence
  synthetic [barcode part1]
cagaggtaggttgtcg

SEQ ID NO: 38554 - DNA, 16 bp, Artificial Sequence
  synthetic [barcode part1]
ccgagatcactgtagt

SEQ ID NO: 38555 - DNA, 16 bp, Artificial Sequence
  synthetic [barcode part1]
cgagattgaccgattc

SEQ ID NO: 38556 - DNA, 16 bp, Artificial Sequence
  synthetic [barcode part1]
tagtgaactacgaacg

SEQ ID NO: 38557 - DNA, 16 bp, Artificial Sequence
  synthetic [barcode part1]
ataaccggagatcaac

SEQ ID NO: 38558 - DNA, 16 bp, Artificial Sequence
  synthetic [barcode part1]
gtgtagtctctgattc

SEQ ID NO: 38559 - DNA, 16 bp, Artificial Sequence
  synthetic [barcode part1]
gcggtcaagaattaac

SEQ ID NO: 38560 - DNA, 16 bp, Artificial Sequence
  synthetic [barcode part1]
gacgattcttccgcac

SEQ ID NO: 38561 - DNA, 16 bp, Artificial Sequence
  synthetic [barcode part1]
tggacgtacacaacct

SEQ ID NO: 38562 - DNA, 16 bp, Artificial Sequence
  synthetic [barcode part1]
caagttattcctgcgt

SEQ ID NO: 38563 - DNA, 16 bp, Artificial Sequence
  synthetic [barcode part1]
acgtgcctgttctgtg

SEQ ID NO: 38564 - DNA, 16 bp, Artificial Sequence
  synthetic [barcode part1]
tagaaggccgatcctt

SEQ ID NO: 38565 - DNA, 16 bp, Artificial Sequence
  synthetic [barcode part1]
aacgtgtgtacaccac

SEQ ID NO: 38566 - DNA, 16 bp, Artificial Sequence
  synthetic [barcode part1]
cctcgtgatacagagt

SEQ ID NO: 38567 - DNA, 16 bp, Artificial Sequence
  synthetic [barcode part1]
acgtacgcagttggtt

SEQ ID NO: 38568 - DNA, 16 bp, Artificial Sequence
  synthetic [barcode part1]
taactctgcacgtcgc

SEQ ID NO: 38569 - DNA, 16 bp, Artificial Sequence
  synthetic [barcode part1]
cgattgtcaccgatag

SEQ ID NO: 38570 - DNA, 16 bp, Artificial Sequence
  synthetic [barcode part1]
gatatcctcaccaccg

SEQ ID NO: 38571 - DNA, 16 bp, Artificial Sequence
  synthetic [barcode part1]
cgtccgaagaggttag

SEQ ID NO: 38572 - DNA, 16 bp, Artificial Sequence
  synthetic [barcode part1]
cgtcacgtcaatcaag

SEQ ID NO: 38573 - DNA, 16 bp, Artificial Sequence
  synthetic [barcode part1]
attaccttcacgagtc

SEQ ID NO: 38574 - DNA, 16 bp, Artificial Sequence
  synthetic [barcode part1]
tgtggtgtcgtccact

SEQ ID NO: 38575 - DNA, 16 bp, Artificial Sequence
  synthetic [barcode part1]
atctgtctagagtcct

SEQ ID NO: 38576 - DNA, 16 bp, Artificial Sequence
  synthetic [barcode part1]
tgacgatcaacctgac

SEQ ID NO: 38577 - DNA, 16 bp, Artificial Sequence
  synthetic [barcode part1]
cgtatagatcctccgc

SEQ ID NO: 38578 - DNA, 16 bp, Artificial Sequence
  synthetic [barcode part1]
tggacaccaacggagt

SEQ ID NO: 38579 - DNA, 16 bp, Artificial Sequence
  synthetic [barcode part1]
attgcgaactctaggc

SEQ ID NO: 38580 - DNA, 16 bp, Artificial Sequence
  synthetic [barcode part1]
gtcctgtatccttcac

SEQ ID NO: 38581 - DNA, 16 bp, Artificial Sequence
  synthetic [barcode part1]
ttcgagaatacgcgtc

SEQ ID NO: 38582 - DNA, 16 bp, Artificial Sequence
  synthetic [barcode part1]
agtacgtgttgcacac

SEQ ID NO: 38583 - DNA, 16 bp, Artificial Sequence
  synthetic [barcode part1]
agaggcgcgaattatt

SEQ ID NO: 38584 - DNA, 16 bp, Artificial Sequence
  synthetic [barcode part1]
actctcgacgagaatc

SEQ ID NO: 38585 - DNA, 16 bp, Artificial Sequence
  synthetic [barcode part1]
tgattatcggagaacg

SEQ ID NO: 38586 - DNA, 16 bp, Artificial Sequence
  synthetic [barcode part1]
tggcgtgtcaagtatc

SEQ ID NO: 38587 - DNA, 16 bp, Artificial Sequence
  synthetic [barcode part1]
attacgcaggataacg

SEQ ID NO: 38588 - DNA, 16 bp, Artificial Sequence
  synthetic [barcode part1]
tactggtgtaccagtg

SEQ ID NO: 38589 - DNA, 16 bp, Artificial Sequence
  synthetic [barcode part1]
gttgtgtagtctgcag

SEQ ID NO: 38590 - DNA, 16 bp, Artificial Sequence
  synthetic [barcode part1]
attcgaggtaataggc

SEQ ID NO: 38591 - DNA, 16 bp, Artificial Sequence
  synthetic [barcode part1]
attgtctgtctacgac

SEQ ID NO: 38592 - DNA, 16 bp, Artificial Sequence
  synthetic [barcode part1]
ttacctatccacctgc

SEQ ID NO: 38593 - DNA, 16 bp, Artificial Sequence
  synthetic [barcode part1]
aacctgagtcagatcc

SEQ ID NO: 38594 - DNA, 16 bp, Artificial Sequence
  synthetic [barcode part1]
taggacgtaccgacag

SEQ ID NO: 38595 - DNA, 16 bp, Artificial Sequence
  synthetic [barcode part1]
acgcggttgtatagtc

SEQ ID NO: 38596 - DNA, 16 bp, Artificial Sequence
  synthetic [barcode part1]
actcctgtaggttgcc

SEQ ID NO: 38597 - DNA, 16 bp, Artificial Sequence
  synthetic [barcode part1]
gtatctgactcgcaag

SEQ ID NO: 38598 - DNA, 16 bp, Artificial Sequence
  synthetic [barcode part1]
acgaacggacactacg

SEQ ID NO: 38599 - DNA, 16 bp, Artificial Sequence
  synthetic [barcode part1]
acgagtggccttgaag

SEQ ID NO: 38600 - DNA, 16 bp, Artificial Sequence
  synthetic [barcode part1]
gtcggaccactcttac

SEQ ID NO: 38601 - DNA, 16 bp, Artificial Sequence
  synthetic [barcode part1]
gagtgttccacagatc

SEQ ID NO: 38602 - DNA, 16 bp, Artificial Sequence
  synthetic [barcode part1]
tagacaatccaaggtg

SEQ ID NO: 38603 - DNA, 16 bp, Artificial Sequence
  synthetic [barcode part1]
ccacgcacaattgtag

SEQ ID NO: 38604 - DNA, 16 bp, Artificial Sequence
  synthetic [barcode part1]
aagttgaatcagtgcg

SEQ ID NO: 38605 - DNA, 16 bp, Artificial Sequence
  synthetic [barcode part1]
tgcagtatattgcggc

SEQ ID NO: 38606 - DNA, 16 bp, Artificial Sequence
  synthetic [barcode part1]
accagacttacgttct

SEQ ID NO: 38607 - DNA, 16 bp, Artificial Sequence
  synthetic [barcode part1]
gtggttaggaactaac

SEQ ID NO: 38608 - DNA, 16 bp, Artificial Sequence
  synthetic [barcode part1]
aacctcctcgacgtac

SEQ ID NO: 38609 - DNA, 16 bp, Artificial Sequence
  synthetic [barcode part1]
gactacaccagtctcc

SEQ ID NO: 38610 - DNA, 16 bp, Artificial Sequence
  synthetic [barcode part1]
acactctcgtggaagt

SEQ ID NO: 38611 - DNA, 16 bp, Artificial Sequence
  synthetic [barcode part1]
caattcgactcgacag

SEQ ID NO: 38612 - DNA, 16 bp, Artificial Sequence
  synthetic [barcode part1]
acaagtcgttgtcttc

SEQ ID NO: 38613 - DNA, 16 bp, Artificial Sequence
  synthetic [barcode part1]
atcctcgtgagttatc

SEQ ID NO: 38614 - DNA, 16 bp, Artificial Sequence
  synthetic [barcode part1]
ttcggagtggtactgt

SEQ ID NO: 38615 - DNA, 16 bp, Artificial Sequence
  synthetic [barcode part1]
tctccgtcctgtattg

SEQ ID NO: 38616 - DNA, 16 bp, Artificial Sequence
  synthetic [barcode part1]
gcagaggtggttcagt

SEQ ID NO: 38617 - DNA, 16 bp, Artificial Sequence
  synthetic [barcode part1]
acggacactataacag

SEQ ID NO: 38618 - DNA, 16 bp, Artificial Sequence
  synthetic [barcode part1]
atctccggtgattcgc

SEQ ID NO: 38619 - DNA, 16 bp, Artificial Sequence
  synthetic [barcode part1]
aatcgactcaactggc

SEQ ID NO: 38620 - DNA, 16 bp, Artificial Sequence
  synthetic [barcode part1]
caaggacaagtcaccg

SEQ ID NO: 38621 - DNA, 16 bp, Artificial Sequence
  synthetic [barcode part1]
gtctcgtgtctcttac

SEQ ID NO: 38622 - DNA, 16 bp, Artificial Sequence
  synthetic [barcode part1]
tggttacggcggtaag

SEQ ID NO: 38623 - DNA, 16 bp, Artificial Sequence
  synthetic [barcode part1]
acaactgttctctgac

SEQ ID NO: 38624 - DNA, 16 bp, Artificial Sequence
  synthetic [barcode part1]
aattgcggattggaac

SEQ ID NO: 38625 - DNA, 16 bp, Artificial Sequence
  synthetic [barcode part1]
gactactgaactaccg

SEQ ID NO: 38626 - DNA, 16 bp, Artificial Sequence
  synthetic [barcode part1]
tagacgtgtacgactc

SEQ ID NO: 38627 - DNA, 16 bp, Artificial Sequence
  synthetic [barcode part1]
gtccacttcgtggtac

SEQ ID NO: 38628 - DNA, 16 bp, Artificial Sequence
  synthetic [barcode part1]
aggcctgtatcagtac

SEQ ID NO: 38629 - DNA, 16 bp, Artificial Sequence
  synthetic [barcode part1]
actacctcaggtactt

SEQ ID NO: 38630 - DNA, 16 bp, Artificial Sequence
  synthetic [barcode part1]
actcggccacaagaag

SEQ ID NO: 38631 - DNA, 16 bp, Artificial Sequence
  synthetic [barcode part1]
agacctactacgtgac

SEQ ID NO: 38632 - DNA, 16 bp, Artificial Sequence
  synthetic [barcode part1]
tgacgtatcagtgtgc

SEQ ID NO: 38633 - DNA, 16 bp, Artificial Sequence
  synthetic [barcode part1]
tccagtcttggaagac

SEQ ID NO: 38634 - DNA, 16 bp, Artificial Sequence
  synthetic [barcode part1]
ttgtgttcgaatcgtc

SEQ ID NO: 38635 - DNA, 16 bp, Artificial Sequence
  synthetic [barcode part1]
tcgtaagactccttac

SEQ ID NO: 38636 - DNA, 16 bp, Artificial Sequence
  synthetic [barcode part1]
agactgtactcgacac

SEQ ID NO: 38637 - DNA, 16 bp, Artificial Sequence
  synthetic [barcode part1]
gtgtgttcgtctcgtg

SEQ ID NO: 38638 - DNA, 16 bp, Artificial Sequence
  synthetic [barcode part1]
aaggacctcaatcctg

SEQ ID NO: 38639 - DNA, 16 bp, Artificial Sequence
  synthetic [barcode part1]
aggataggcagtaggt

SEQ ID NO: 38640 - DNA, 16 bp, Artificial Sequence
  synthetic [barcode part1]
cgaccaagatcctagt

SEQ ID NO: 38641 - DNA, 16 bp, Artificial Sequence
  synthetic [barcode part1]
gagtgagttcaagatc

SEQ ID NO: 38642 - DNA, 16 bp, Artificial Sequence
  synthetic [barcode part1]
agactcttagtcgacg

SEQ ID NO: 38643 - DNA, 16 bp, Artificial Sequence
  synthetic [barcode part1]
gcctcactccaatctt

SEQ ID NO: 38644 - DNA, 16 bp, Artificial Sequence
  synthetic [barcode part1]
tgtagaacctccgtag

SEQ ID NO: 38645 - DNA, 16 bp, Artificial Sequence
  synthetic [barcode part1]
cggcgtacaacttctc

SEQ ID NO: 38646 - DNA, 16 bp, Artificial Sequence
  synthetic [barcode part1]
tgtagtgaacggatac

SEQ ID NO: 38647 - DNA, 16 bp, Artificial Sequence
  synthetic [barcode part1]
acgataccacgatacc

SEQ ID NO: 38648 - DNA, 16 bp, Artificial Sequence
  synthetic [barcode part1]
aagtaaccacggattg

SEQ ID NO: 38649 - DNA, 16 bp, Artificial Sequence
  synthetic [barcode part1]
gcaacagtggacctag

SEQ ID NO: 38650 - DNA, 16 bp, Artificial Sequence
  synthetic [barcode part1]
tactcagttctgtcag

SEQ ID NO: 38651 - DNA, 16 bp, Artificial Sequence
  synthetic [barcode part1]
aggaagaactggtcag

SEQ ID NO: 38652 - DNA, 16 bp, Artificial Sequence
  synthetic [barcode part1]
ccgtgaagttcgagtt

SEQ ID NO: 38653 - DNA, 16 bp, Artificial Sequence
  synthetic [barcode part1]
tatagtggcggtgtct

SEQ ID NO: 38654 - DNA, 16 bp, Artificial Sequence
  synthetic [barcode part1]
cagtactgtcctgaag

SEQ ID NO: 38655 - DNA, 16 bp, Artificial Sequence
  synthetic [barcode part1]
tgtctattcgcctgtc

SEQ ID NO: 38656 - DNA, 16 bp, Artificial Sequence
  synthetic [barcode part1]
caacgatcaacgatcc

SEQ ID NO: 38657 - DNA, 16 bp, Artificial Sequence
  synthetic [barcode part1]
gacacttacagagtag

SEQ ID NO: 38658 - DNA, 16 bp, Artificial Sequence
  synthetic [barcode part1]
cctactaatactcggt

SEQ ID NO: 38659 - DNA, 16 bp, Artificial Sequence
  synthetic [barcode part1]
tcggaacgcctactct

SEQ ID NO: 38660 - DNA, 16 bp, Artificial Sequence
  synthetic [barcode part1]
tgaaccacaacagtcc

SEQ ID NO: 38661 - DNA, 16 bp, Artificial Sequence
  synthetic [barcode part1]
agttcggcacgtcctt

SEQ ID NO: 38662 - DNA, 16 bp, Artificial Sequence
  synthetic [barcode part1]
aaggttctctggagtc

SEQ ID NO: 38663 - DNA, 16 bp, Artificial Sequence
  synthetic [barcode part1]
caccaagatctctgtt

SEQ ID NO: 38664 - DNA, 16 bp, Artificial Sequence
  synthetic [barcode part1]
gtatcgtctactcgcg

SEQ ID NO: 38665 - DNA, 16 bp, Artificial Sequence
  synthetic [barcode part1]
gacctaaccttcgcac

SEQ ID NO: 38666 - DNA, 16 bp, Artificial Sequence
  synthetic [barcode part1]
gacttggagtccgatt

SEQ ID NO: 38667 - DNA, 16 bp, Artificial Sequence
  synthetic [barcode part1]
aaggaccgtatatcag

SEQ ID NO: 38668 - DNA, 16 bp, Artificial Sequence
  synthetic [barcode part1]
atctcgactaggatcg

SEQ ID NO: 38669 - DNA, 16 bp, Artificial Sequence
  synthetic [barcode part1]
gtcctgttagattcac

SEQ ID NO: 38670 - DNA, 16 bp, Artificial Sequence
  synthetic [barcode part1]
ttaattcctcgcgagt

SEQ ID NO: 38671 - DNA, 16 bp, Artificial Sequence
  synthetic [barcode part1]
tcctagtcttccggtt

SEQ ID NO: 38672 - DNA, 16 bp, Artificial Sequence
  synthetic [barcode part1]
cgatcgccttaactcg

SEQ ID NO: 38673 - DNA, 16 bp, Artificial Sequence
  synthetic [barcode part1]
gtattcgaccttgttg

SEQ ID NO: 38674 - DNA, 16 bp, Artificial Sequence
  synthetic [barcode part1]
cgtgattagttgtgcg

SEQ ID NO: 38675 - DNA, 16 bp, Artificial Sequence
  synthetic [barcode part1]
gtctcgtgtggaatac

SEQ ID NO: 38676 - DNA, 16 bp, Artificial Sequence
  synthetic [barcode part1]
cacactcgataattcc

SEQ ID NO: 38677 - DNA, 16 bp, Artificial Sequence
  synthetic [barcode part1]
acgccactaggtgaag

SEQ ID NO: 38678 - DNA, 16 bp, Artificial Sequence
  synthetic [barcode part1]
actggtaggatcggac

SEQ ID NO: 38679 - DNA, 16 bp, Artificial Sequence
  synthetic [barcode part1]
tgacgtaatcggaggc

SEQ ID NO: 38680 - DNA, 16 bp, Artificial Sequence
  synthetic [barcode part1]
tacaacgtggatagac

SEQ ID NO: 38681 - DNA, 16 bp, Artificial Sequence
  synthetic [barcode part1]
cggccagaatcttagt

SEQ ID NO: 38682 - DNA, 16 bp, Artificial Sequence
  synthetic [barcode part1]
ttccgcaggtccaatc

SEQ ID NO: 38683 - DNA, 16 bp, Artificial Sequence
  synthetic [barcode part1]
gtaacctactcttacg

SEQ ID NO: 38684 - DNA, 16 bp, Artificial Sequence
  synthetic [barcode part1]
tcacgaacctgtagac

SEQ ID NO: 38685 - DNA, 16 bp, Artificial Sequence
  synthetic [barcode part1]
tgcggataacgttcgt

SEQ ID NO: 38686 - DNA, 16 bp, Artificial Sequence
  synthetic [barcode part1]
tagactcaagtccacg

SEQ ID NO: 38687 - DNA, 16 bp, Artificial Sequence
  synthetic [barcode part1]
acctattgttcgcctc

SEQ ID NO: 38688 - DNA, 16 bp, Artificial Sequence
  synthetic [barcode part1]
ttggtactgcacaacg

SEQ ID NO: 38689 - DNA, 16 bp, Artificial Sequence
  synthetic [barcode part1]
tggattcagacgatag

SEQ ID NO: 38690 - DNA, 16 bp, Artificial Sequence
  synthetic [barcode part1]
cgaatatcgcgttggt

SEQ ID NO: 38691 - DNA, 16 bp, Artificial Sequence
  synthetic [barcode part1]
gattacctaaggacag

SEQ ID NO: 38692 - DNA, 16 bp, Artificial Sequence
  synthetic [barcode part1]
gagacttagacagatc

SEQ ID NO: 38693 - DNA, 16 bp, Artificial Sequence
  synthetic [barcode part1]
tgttactgcggttgcc

SEQ ID NO: 38694 - DNA, 16 bp, Artificial Sequence
  synthetic [barcode part1]
agatctctgcgtgtag

SEQ ID NO: 38695 - DNA, 16 bp, Artificial Sequence
  synthetic [barcode part1]
taggtcgttccgcact

SEQ ID NO: 38696 - DNA, 16 bp, Artificial Sequence
  synthetic [barcode part1]
gaagtattggcagttg

SEQ ID NO: 38697 - DNA, 16 bp, Artificial Sequence
  synthetic [barcode part1]
gaggtgatactgtctc

SEQ ID NO: 38698 - DNA, 16 bp, Artificial Sequence
  synthetic [barcode part1]
tcctgtgcgatctgac

SEQ ID NO: 38699 - DNA, 16 bp, Artificial Sequence
  synthetic [barcode part1]
gatagattccagaacg

SEQ ID NO: 38700 - DNA, 16 bp, Artificial Sequence
  synthetic [barcode part1]
tgattcctgcgtaact

SEQ ID NO: 38701 - DNA, 16 bp, Artificial Sequence
  synthetic [barcode part1]
attgtctcaggtgttc

SEQ ID NO: 38702 - DNA, 16 bp, Artificial Sequence
  synthetic [barcode part1]
ccaggaagtgcaatcg

SEQ ID NO: 38703 - DNA, 16 bp, Artificial Sequence
  synthetic [barcode part1]
cggattaagaagtacc

SEQ ID NO: 38704 - DNA, 16 bp, Artificial Sequence
  synthetic [barcode part1]
atcacaaggcaggcgt

SEQ ID NO: 38705 - DNA, 16 bp, Artificial Sequence
  synthetic [barcode part1]
caaggaacgtgtgatt

SEQ ID NO: 38706 - DNA, 16 bp, Artificial Sequence
  synthetic [barcode part1]
aagatcctgtctactc

SEQ ID NO: 38707 - DNA, 16 bp, Artificial Sequence
  synthetic [barcode part1]
agtccttcgactctct

SEQ ID NO: 38708 - DNA, 16 bp, Artificial Sequence
  synthetic [barcode part1]
tcaagtggtgaactcc

SEQ ID NO: 38709 - DNA, 16 bp, Artificial Sequence
  synthetic [barcode part1]
gtggccacttcgattc

SEQ ID NO: 38710 - DNA, 16 bp, Artificial Sequence
  synthetic [barcode part1]
gcagagtcagagtaag

SEQ ID NO: 38711 - DNA, 16 bp, Artificial Sequence
  synthetic [barcode part1]
aactgtcctacgtccg

SEQ ID NO: 38712 - DNA, 16 bp, Artificial Sequence
  synthetic [barcode part1]
gaggatatccaacagt

SEQ ID NO: 38713 - DNA, 16 bp, Artificial Sequence
  synthetic [barcode part1]
aggttcgacctaggtt

SEQ ID NO: 38714 - DNA, 16 bp, Artificial Sequence
  synthetic [barcode part1]
tctgcaatccgtcacg

SEQ ID NO: 38715 - DNA, 16 bp, Artificial Sequence
  synthetic [barcode part1]
gcacaattcctctaac

SEQ ID NO: 38716 - DNA, 16 bp, Artificial Sequence
  synthetic [barcode part1]
tgcacctaacaattcc

SEQ ID NO: 38717 - DNA, 16 bp, Artificial Sequence
  synthetic [barcode part1]
atcctccgttgacacg

SEQ ID NO: 38718 - DNA, 16 bp, Artificial Sequence
  synthetic [barcode part1]
cggtagttgcgaaggt

SEQ ID NO: 38719 - DNA, 16 bp, Artificial Sequence
  synthetic [barcode part1]
tcacctcctgagtacg

SEQ ID NO: 38720 - DNA, 16 bp, Artificial Sequence
  synthetic [barcode part1]
agtgatcctgagttgc

SEQ ID NO: 38721 - DNA, 16 bp, Artificial Sequence
  synthetic [barcode part1]
gcacttctagtgattc

SEQ ID NO: 38722 - DNA, 16 bp, Artificial Sequence
  synthetic [barcode part1]
ccagagagattgtgcg

SEQ ID NO: 38723 - DNA, 16 bp, Artificial Sequence
  synthetic [barcode part1]
gacgcgtgattaaggc

SEQ ID NO: 38724 - DNA, 16 bp, Artificial Sequence
  synthetic [barcode part1]
cgttaccacctagacc

SEQ ID NO: 38725 - DNA, 16 bp, Artificial Sequence
  synthetic [barcode part1]
gtgattaggttctcct

SEQ ID NO: 38726 - DNA, 16 bp, Artificial Sequence
  synthetic [barcode part1]
cactgaagttcctgcc

SEQ ID NO: 38727 - DNA, 16 bp, Artificial Sequence
  synthetic [barcode part1]
agtgaccttgagtcgt

SEQ ID NO: 38728 - DNA, 16 bp, Artificial Sequence
  synthetic [barcode part1]
cactccaagtatccgc

SEQ ID NO: 38729 - DNA, 16 bp, Artificial Sequence
  synthetic [barcode part1]
aaggtaatctggacac

SEQ ID NO: 38730 - DNA, 16 bp, Artificial Sequence
  synthetic [barcode part1]
accacagaggtgaatt

SEQ ID NO: 38731 - DNA, 16 bp, Artificial Sequence
  synthetic [barcode part1]
ttgagtcacgtctccg

SEQ ID NO: 38732 - DNA, 16 bp, Artificial Sequence
  synthetic [barcode part1]
tactaatcagtgcgcg

SEQ ID NO: 38733 - DNA, 16 bp, Artificial Sequence
  synthetic [barcode part1]
tacacttccactgaac

SEQ ID NO: 38734 - DNA, 16 bp, Artificial Sequence
  synthetic [barcode part1]
agattccgtatcgcag

SEQ ID NO: 38735 - DNA, 16 bp, Artificial Sequence
  synthetic [barcode part1]
aatcacgaactgagac

SEQ ID NO: 38736 - DNA, 16 bp, Artificial Sequence
  synthetic [barcode part1]
gagatcgcgatagaag

SEQ ID NO: 38737 - DNA, 16 bp, Artificial Sequence
  synthetic [barcode part1]
tcagatctgacggttg

SEQ ID NO: 38738 - DNA, 16 bp, Artificial Sequence
  synthetic [barcode part1]
ttgcctgagactccac

SEQ ID NO: 38739 - DNA, 16 bp, Artificial Sequence
  synthetic [barcode part1]
tggcgattgtgcctct

SEQ ID NO: 38740 - DNA, 16 bp, Artificial Sequence
  synthetic [barcode part1]
acaatcgcctcgatcc

SEQ ID NO: 38741 - DNA, 16 bp, Artificial Sequence
  synthetic [barcode part1]
actggactattcctgt

SEQ ID NO: 38742 - DNA, 16 bp, Artificial Sequence
  synthetic [barcode part1]
atagtcgaggactggc

SEQ ID NO: 38743 - DNA, 16 bp, Artificial Sequence
  synthetic [barcode part1]
agtctaccgaggcaag

SEQ ID NO: 38744 - DNA, 16 bp, Artificial Sequence
  synthetic [barcode part1]
tctaacgccacgtctg

SEQ ID NO: 38745 - DNA, 16 bp, Artificial Sequence
  synthetic [barcode part1]
attcaggtctgagtgc

SEQ ID NO: 38746 - DNA, 16 bp, Artificial Sequence
  synthetic [barcode part1]
tggccgattagtcaac

SEQ ID NO: 38747 - DNA, 16 bp, Artificial Sequence
  synthetic [barcode part1]
agaacggtcgtaggtc

SEQ ID NO: 38748 - DNA, 16 bp, Artificial Sequence
  synthetic [barcode part1]
gcaataataggcctag

SEQ ID NO: 38749 - DNA, 16 bp, Artificial Sequence
  synthetic [barcode part1]
ttaccgcgtctacgac

SEQ ID NO: 38750 - DNA, 16 bp, Artificial Sequence
  synthetic [barcode part1]
ccgcgtagacttcttg

SEQ ID NO: 38751 - DNA, 16 bp, Artificial Sequence
  synthetic [barcode part1]
tctattcacgacgttg

SEQ ID NO: 38752 - DNA, 16 bp, Artificial Sequence
  synthetic [barcode part1]
tatcgagataggaacc

SEQ ID NO: 38753 - DNA, 16 bp, Artificial Sequence
  synthetic [barcode part1]
acagattctctcgact

SEQ ID NO: 38754 - DNA, 16 bp, Artificial Sequence
  synthetic [barcode part1]
ttcgcgttcaagttac

SEQ ID NO: 38755 - DNA, 16 bp, Artificial Sequence
  synthetic [barcode part1]
attcgacctcttacag

SEQ ID NO: 38756 - DNA, 16 bp, Artificial Sequence
  synthetic [barcode part1]
cagagttggaatctcc

SEQ ID NO: 38757 - DNA, 16 bp, Artificial Sequence
  synthetic [barcode part1]
ttcaccgccaggtatc

SEQ ID NO: 38758 - DNA, 16 bp, Artificial Sequence
  synthetic [barcode part1]
gcagtgccaatatcac

SEQ ID NO: 38759 - DNA, 16 bp, Artificial Sequence
  synthetic [barcode part1]
acagaatcctagacag

SEQ ID NO: 38760 - DNA, 16 bp, Artificial Sequence
  synthetic [barcode part1]
aggccgcagtacaagt

SEQ ID NO: 38761 - DNA, 16 bp, Artificial Sequence
  synthetic [barcode part1]
ttccacctccggatag

SEQ ID NO: 38762 - DNA, 16 bp, Artificial Sequence
  synthetic [barcode part1]
gagacctcgagattct

SEQ ID NO: 38763 - DNA, 16 bp, Artificial Sequence
  synthetic [barcode part1]
ttgcaagtatcggtgc

SEQ ID NO: 38764 - DNA, 16 bp, Artificial Sequence
  synthetic [barcode part1]
acaactgacacactgc

SEQ ID NO: 38765 - DNA, 16 bp, Artificial Sequence
  synthetic [barcode part1]
attaactaccgtggcg

SEQ ID NO: 38766 - DNA, 16 bp, Artificial Sequence
  synthetic [barcode part1]
aggtgagtgagactcc

SEQ ID NO: 38767 - DNA, 16 bp, Artificial Sequence
  synthetic [barcode part1]
tgcctcgtaggtacct

SEQ ID NO: 38768 - DNA, 16 bp, Artificial Sequence
  synthetic [barcode part1]
taataacctggaccgc

SEQ ID NO: 38769 - DNA, 16 bp, Artificial Sequence
  synthetic [barcode part1]
tagttaatcgaccggc

SEQ ID NO: 38770 - DNA, 16 bp, Artificial Sequence
  synthetic [barcode part1]
agtagtcttctcgcgc

SEQ ID NO: 38771 - DNA, 16 bp, Artificial Sequence
  synthetic [barcode part1]
ttaacctgtggagtgc

SEQ ID NO: 38772 - DNA, 16 bp, Artificial Sequence
  synthetic [barcode part1]
agtaaggcgacagagt

SEQ ID NO: 38773 - DNA, 16 bp, Artificial Sequence
  synthetic [barcode part1]
tcgactccaggttcac

SEQ ID NO: 38774 - DNA, 16 bp, Artificial Sequence
  synthetic [barcode part1]
gaagaccagttcttcg

SEQ ID NO: 38775 - DNA, 16 bp, Artificial Sequence
  synthetic [barcode part1]
tctcaacctagtgtgt

SEQ ID NO: 38776 - DNA, 16 bp, Artificial Sequence
  synthetic [barcode part1]
atcgtacctcctgacg

SEQ ID NO: 38777 - DNA, 16 bp, Artificial Sequence
  synthetic [barcode part1]
gtcctctaccgatacg

SEQ ID NO: 38778 - DNA, 16 bp, Artificial Sequence
  synthetic [barcode part1]
ttatatcgcctggtgt

SEQ ID NO: 38779 - DNA, 16 bp, Artificial Sequence
  synthetic [barcode part1]
taggtgccgacttcct

SEQ ID NO: 38780 - DNA, 16 bp, Artificial Sequence
  synthetic [barcode part1]
tctccgataaccgtgc

SEQ ID NO: 38781 - DNA, 16 bp, Artificial Sequence
  synthetic [barcode part1]
tctgaactctaacctg

SEQ ID NO: 38782 - DNA, 16 bp, Artificial Sequence
  synthetic [barcode part1]
tactggtgtcagtacg

SEQ ID NO: 38783 - DNA, 16 bp, Artificial Sequence
  synthetic [barcode part1]
aagaggatcaaggtcg

SEQ ID NO: 38784 - DNA, 16 bp, Artificial Sequence
  synthetic [barcode part1]
tcaacctgttcggatt

SEQ ID NO: 38785 - DNA, 16 bp, Artificial Sequence
  synthetic [barcode part1]
cgttactgtgactgtt

SEQ ID NO: 38786 - DNA, 16 bp, Artificial Sequence
  synthetic [barcode part1]
aacacaagacgattcg

SEQ ID NO: 38787 - DNA, 16 bp, Artificial Sequence
  synthetic [barcode part1]
atcggatacaggaatc

SEQ ID NO: 38788 - DNA, 16 bp, Artificial Sequence
  synthetic [barcode part1]
atcgtcagtacctccg

SEQ ID NO: 38789 - DNA, 16 bp, Artificial Sequence
  synthetic [barcode part1]
tcgtcgccgtctaagt

SEQ ID NO: 38790 - DNA, 16 bp, Artificial Sequence
  synthetic [barcode part1]
tcgttgtcgaacactt

SEQ ID NO: 38791 - DNA, 16 bp, Artificial Sequence
  synthetic [barcode part1]
tccgtcgagttgcact

SEQ ID NO: 38792 - DNA, 16 bp, Artificial Sequence
  synthetic [barcode part1]
ttgactgccaactgag

SEQ ID NO: 38793 - DNA, 16 bp, Artificial Sequence
  synthetic [barcode part1]
tccacgcagttcggtt

SEQ ID NO: 38794 - DNA, 16 bp, Artificial Sequence
  synthetic [barcode part1]
cacctgtacaagtgac

SEQ ID NO: 38795 - DNA, 16 bp, Artificial Sequence
  synthetic [barcode part1]
ccgttaagtcaagtcg

SEQ ID NO: 38796 - DNA, 16 bp, Artificial Sequence
  synthetic [barcode part1]
actgtcacaacaaccg

SEQ ID NO: 38797 - DNA, 16 bp, Artificial Sequence
  synthetic [barcode part1]
ttacttggcgagtgac

SEQ ID NO: 38798 - DNA, 16 bp, Artificial Sequence
  synthetic [barcode part1]
gtatacggttggtcac

SEQ ID NO: 38799 - DNA, 16 bp, Artificial Sequence
  synthetic [barcode part1]
acctcaacggttaacg

SEQ ID NO: 38800 - DNA, 16 bp, Artificial Sequence
  synthetic [barcode part1]
cctgatactacgcctg

SEQ ID NO: 38801 - DNA, 16 bp, Artificial Sequence
  synthetic [barcode part1]
atcggacctactgagt

SEQ ID NO: 38802 - DNA, 16 bp, Artificial Sequence
  synthetic [barcode part1]
ccgaattcgcgttctg

SEQ ID NO: 38803 - DNA, 16 bp, Artificial Sequence
  synthetic [barcode part1]
cgccacttcgttactt

SEQ ID NO: 38804 - DNA, 16 bp, Artificial Sequence
  synthetic [barcode part1]
gtaccgacttctgatt

SEQ ID NO: 38805 - DNA, 16 bp, Artificial Sequence
  synthetic [barcode part1]
cgtgtgaccactgtct

SEQ ID NO: 38806 - DNA, 16 bp, Artificial Sequence
  synthetic [barcode part1]
aggtataaccagatcg

SEQ ID NO: 38807 - DNA, 16 bp, Artificial Sequence
  synthetic [barcode part1]
gactgcacagtacgtt

SEQ ID NO: 38808 - DNA, 16 bp, Artificial Sequence
  synthetic [barcode part1]
cagataaccacaacag

SEQ ID NO: 38809 - DNA, 16 bp, Artificial Sequence
  synthetic [barcode part1]
gtactcttcggtaact

SEQ ID NO: 38810 - DNA, 16 bp, Artificial Sequence
  synthetic [barcode part1]
caatcttgcgccgatc

SEQ ID NO: 38811 - DNA, 16 bp, Artificial Sequence
  synthetic [barcode part1]
caactccagtctcttc

SEQ ID NO: 38812 - DNA, 16 bp, Artificial Sequence
  synthetic [barcode part1]
cgccgaacagagatac

SEQ ID NO: 38813 - DNA, 16 bp, Artificial Sequence
  synthetic [barcode part1]
gcagtgatacttcgtg

SEQ ID NO: 38814 - DNA, 16 bp, Artificial Sequence
  synthetic [barcode part1]
acacacacaactgacc

SEQ ID NO: 38815 - DNA, 16 bp, Artificial Sequence
  synthetic [barcode part1]
tatccagactactctg

SEQ ID NO: 38816 - DNA, 16 bp, Artificial Sequence
  synthetic [barcode part1]
ttatctgcctagaacc

SEQ ID NO: 38817 - DNA, 16 bp, Artificial Sequence
  synthetic [barcode part1]
cgtacagtatctcgtt

SEQ ID NO: 38818 - DNA, 16 bp, Artificial Sequence
  synthetic [barcode part1]
accaactgaccaactg

SEQ ID NO: 38819 - DNA, 16 bp, Artificial Sequence
  synthetic [barcode part1]
tgtcaggtaccagact

SEQ ID NO: 38820 - DNA, 16 bp, Artificial Sequence
  synthetic [barcode part1]
tggaacggtagttgcg

SEQ ID NO: 38821 - DNA, 16 bp, Artificial Sequence
  synthetic [barcode part1]
atctcgtgtaaggcgt

SEQ ID NO: 38822 - DNA, 16 bp, Artificial Sequence
  synthetic [barcode part1]
ccaacggcacttctac

SEQ ID NO: 38823 - DNA, 16 bp, Artificial Sequence
  synthetic [barcode part1]
acgttggttcttgact

SEQ ID NO: 38824 - DNA, 16 bp, Artificial Sequence
  synthetic [barcode part1]
ttctggtggttacact

SEQ ID NO: 38825 - DNA, 16 bp, Artificial Sequence
  synthetic [barcode part1]
tcaacacacgttgacg

SEQ ID NO: 38826 - DNA, 16 bp, Artificial Sequence
  synthetic [barcode part1]
tcgtaccttgccgaac

SEQ ID NO: 38827 - DNA, 16 bp, Artificial Sequence
  synthetic [barcode part1]
gattctgtgtcgcaag

SEQ ID NO: 38828 - DNA, 16 bp, Artificial Sequence
  synthetic [barcode part1]
acagatcttggcgtac

SEQ ID NO: 38829 - DNA, 16 bp, Artificial Sequence
  synthetic [barcode part1]
tcaacagtatccttgc

SEQ ID NO: 38830 - DNA, 16 bp, Artificial Sequence
  synthetic [barcode part1]
cactgccttactgtct

SEQ ID NO: 38831 - DNA, 16 bp, Artificial Sequence
  synthetic [barcode part1]
gaatctgtctgcagac

SEQ ID NO: 38832 - DNA, 16 bp, Artificial Sequence
  synthetic [barcode part1]
tcgagttgttaggtcg

SEQ ID NO: 38833 - DNA, 16 bp, Artificial Sequence
  synthetic [barcode part1]
gttgtccttcagatac

SEQ ID NO: 38834 - DNA, 16 bp, Artificial Sequence
  synthetic [barcode part1]
gcaccttaatccggtc

SEQ ID NO: 38835 - DNA, 16 bp, Artificial Sequence
  synthetic [barcode part1]
tgagatcctgagatcc

SEQ ID NO: 38836 - DNA, 16 bp, Artificial Sequence
  synthetic [barcode part1]
gtgttcaacgaacctg

SEQ ID NO: 38837 - DNA, 16 bp, Artificial Sequence
  synthetic [barcode part1]
tgaaccgaggacgtgt

SEQ ID NO: 38838 - DNA, 16 bp, Artificial Sequence
  synthetic [barcode part1]
aggacgtaagagtgtg

SEQ ID NO: 38839 - DNA, 16 bp, Artificial Sequence
  synthetic [barcode part1]
actaccaacgttcttg

SEQ ID NO: 38840 - DNA, 16 bp, Artificial Sequence
  synthetic [barcode part1]
ccttgcagtgttcttc

SEQ ID NO: 38841 - DNA, 16 bp, Artificial Sequence
  synthetic [barcode part1]
agacgagtgtctatcc

SEQ ID NO: 38842 - DNA, 16 bp, Artificial Sequence
  synthetic [barcode part1]
tggcacagtcaggagt

SEQ ID NO: 38843 - DNA, 16 bp, Artificial Sequence
  synthetic [barcode part1]
tactaagacggcctgt

SEQ ID NO: 38844 - DNA, 16 bp, Artificial Sequence
  synthetic [barcode part1]
cacagattcgtggatc

SEQ ID NO: 38845 - DNA, 16 bp, Artificial Sequence
  synthetic [barcode part1]
taggttgacgtagaac

SEQ ID NO: 38846 - DNA, 16 bp, Artificial Sequence
  synthetic [barcode part1]
gccacgtactgagaag

SEQ ID NO: 38847 - DNA, 16 bp, Artificial Sequence
  synthetic [barcode part1]
ttcaactccttccgac

SEQ ID NO: 38848 - DNA, 16 bp, Artificial Sequence
  synthetic [barcode part1]
accttgcgtaactgcc

SEQ ID NO: 38849 - DNA, 16 bp, Artificial Sequence
  synthetic [barcode part1]
tgacactccgcaatag

SEQ ID NO: 38850 - DNA, 16 bp, Artificial Sequence
  synthetic [barcode part1]
ttggcagacaagagtt

SEQ ID NO: 38851 - DNA, 16 bp, Artificial Sequence
  synthetic [barcode part1]
aacctagagtccagtc

SEQ ID NO: 38852 - DNA, 16 bp, Artificial Sequence
  synthetic [barcode part1]
acaacgttggtgtcac

SEQ ID NO: 38853 - DNA, 16 bp, Artificial Sequence
  synthetic [barcode part1]
tgagatacttgcagag

SEQ ID NO: 38854 - DNA, 16 bp, Artificial Sequence
  synthetic [barcode part1]
gtcgagtaacgacctt

SEQ ID NO: 38855 - DNA, 16 bp, Artificial Sequence
  synthetic [barcode part1]
ttgttattccaggcgt

SEQ ID NO: 38856 - DNA, 16 bp, Artificial Sequence
  synthetic [barcode part1]
aggttaaggcctcttg

SEQ ID NO: 38857 - DNA, 16 bp, Artificial Sequence
  synthetic [barcode part1]
cctcgttgtctacgag

SEQ ID NO: 38858 - DNA, 16 bp, Artificial Sequence
  synthetic [barcode part1]
acggagttggacgttg

SEQ ID NO: 38859 - DNA, 16 bp, Artificial Sequence
  synthetic [barcode part1]
tccagtactgtacttg

SEQ ID NO: 38860 - DNA, 16 bp, Artificial Sequence
  synthetic [barcode part1]
gtatctgacggattcg

SEQ ID NO: 38861 - DNA, 16 bp, Artificial Sequence
  synthetic [barcode part1]
gcgacctcgagaatag

SEQ ID NO: 38862 - DNA, 16 bp, Artificial Sequence
  synthetic [barcode part1]
ttgtaggcaccaacac

SEQ ID NO: 38863 - DNA, 16 bp, Artificial Sequence
  synthetic [barcode part1]
cacaccttgaactgcc

SEQ ID NO: 38864 - DNA, 16 bp, Artificial Sequence
  synthetic [barcode part1]
tgatagtcgacggtct

SEQ ID NO: 38865 - DNA, 16 bp, Artificial Sequence
  synthetic [barcode part1]
tgtgtaaggtgtgcct

SEQ ID NO: 38866 - DNA, 16 bp, Artificial Sequence
  synthetic [barcode part1]
agtggagtgacagaac

SEQ ID NO: 38867 - DNA, 16 bp, Artificial Sequence
  synthetic [barcode part1]
cacgtcttcactggac

SEQ ID NO: 38868 - DNA, 16 bp, Artificial Sequence
  synthetic [barcode part1]
tacgtcaatatcggcg

SEQ ID NO: 38869 - DNA, 16 bp, Artificial Sequence
  synthetic [barcode part1]
taggactggttgactc

SEQ ID NO: 38870 - DNA, 16 bp, Artificial Sequence
  synthetic [barcode part1]
ttattcctcaagtgcg

SEQ ID NO: 38871 - DNA, 16 bp, Artificial Sequence
  synthetic [barcode part1]
cacggtgcctatctac

SEQ ID NO: 38872 - DNA, 16 bp, Artificial Sequence
  synthetic [barcode part1]
gcagtgaattcggacg

SEQ ID NO: 38873 - DNA, 16 bp, Artificial Sequence
  synthetic [barcode part1]
tggcgatcacagaggt

SEQ ID NO: 38874 - DNA, 16 bp, Artificial Sequence
  synthetic [barcode part1]
aacttgcgcagacttg

SEQ ID NO: 38875 - DNA, 16 bp, Artificial Sequence
  synthetic [barcode part1]
tccgatctgcaaccac

SEQ ID NO: 38876 - DNA, 16 bp, Artificial Sequence
  synthetic [barcode part1]
aacaatcgcacttcct

SEQ ID NO: 38877 - DNA, 16 bp, Artificial Sequence
  synthetic [barcode part1]
cctacaatccaggtag

SEQ ID NO: 38878 - DNA, 16 bp, Artificial Sequence
  synthetic [barcode part1]
aaggcctcgaacgagt

SEQ ID NO: 38879 - DNA, 16 bp, Artificial Sequence
  synthetic [barcode part1]
gagtggaggattccac

SEQ ID NO: 38880 - DNA, 16 bp, Artificial Sequence
  synthetic [barcode part1]
cctaggcacaattacg

SEQ ID NO: 38881 - DNA, 16 bp, Artificial Sequence
  synthetic [barcode part1]
gtctgtagttattccg

SEQ ID NO: 38882 - DNA, 16 bp, Artificial Sequence
  synthetic [barcode part1]
gttgatccagtgtcag

SEQ ID NO: 38883 - DNA, 16 bp, Artificial Sequence
  synthetic [barcode part1]
cgcctatagtgtcgtc

SEQ ID NO: 38884 - DNA, 16 bp, Artificial Sequence
  synthetic [barcode part1]
cctcgtgttgaattgt

SEQ ID NO: 38885 - DNA, 16 bp, Artificial Sequence
  synthetic [barcode part1]
ttgtgactggtcagtg

SEQ ID NO: 38886 - DNA, 16 bp, Artificial Sequence
  synthetic [barcode part1]
gataagaacacggttc

SEQ ID NO: 38887 - DNA, 16 bp, Artificial Sequence
  synthetic [barcode part1]
gaccttctgtaggtcc

SEQ ID NO: 38888 - DNA, 16 bp, Artificial Sequence
  synthetic [barcode part1]
tggcacgtgtagattc

SEQ ID NO: 38889 - DNA, 16 bp, Artificial Sequence
  synthetic [barcode part1]
ttccttcctctaaggc

SEQ ID NO: 38890 - DNA, 16 bp, Artificial Sequence
  synthetic [barcode part1]
acagaggcaactcgac

SEQ ID NO: 38891 - DNA, 16 bp, Artificial Sequence
  synthetic [barcode part1]
tggcacacagtggagt

SEQ ID NO: 38892 - DNA, 16 bp, Artificial Sequence
  synthetic [barcode part1]
gcggttgtaattgtgc

SEQ ID NO: 38893 - DNA, 16 bp, Artificial Sequence
  synthetic [barcode part1]
tcggtaattcggtgac

SEQ ID NO: 38894 - DNA, 16 bp, Artificial Sequence
  synthetic [barcode part1]
tgtgagtggtattcgc

SEQ ID NO: 38895 - DNA, 16 bp, Artificial Sequence
  synthetic [barcode part1]
gactccttccttgatc

SEQ ID NO: 38896 - DNA, 16 bp, Artificial Sequence
  synthetic [barcode part1]
ttctcctatactgcgc

SEQ ID NO: 38897 - DNA, 16 bp, Artificial Sequence
  synthetic [barcode part1]
gtgacgtacgttgtgt

SEQ ID NO: 38898 - DNA, 16 bp, Artificial Sequence
  synthetic [barcode part1]
tcgtctgaacactgcc

SEQ ID NO: 38899 - DNA, 16 bp, Artificial Sequence
  synthetic [barcode part1]
aagaggaagagttccg

SEQ ID NO: 38900 - DNA, 16 bp, Artificial Sequence
  synthetic [barcode part1]
tgacgacactagacct

SEQ ID NO: 38901 - DNA, 16 bp, Artificial Sequence
  synthetic [barcode part1]
atattgacggtgagac

SEQ ID NO: 38902 - DNA, 16 bp, Artificial Sequence
  synthetic [barcode part1]
tggatcgagaagtact

SEQ ID NO: 38903 - DNA, 16 bp, Artificial Sequence
  synthetic [barcode part1]
tgttctaggtactcac

SEQ ID NO: 38904 - DNA, 16 bp, Artificial Sequence
  synthetic [barcode part1]
tctatcagtcgaaggc

SEQ ID NO: 38905 - DNA, 16 bp, Artificial Sequence
  synthetic [barcode part1]
tgtgttcgcgagaact

SEQ ID NO: 38906 - DNA, 16 bp, Artificial Sequence
  synthetic [barcode part1]
tcctaataacctgtgc

SEQ ID NO: 38907 - DNA, 16 bp, Artificial Sequence
  synthetic [barcode part1]
gcgtcaatcctcgact

SEQ ID NO: 38908 - DNA, 16 bp, Artificial Sequence
  synthetic [barcode part1]
ccagacctgtagagag

SEQ ID NO: 38909 - DNA, 16 bp, Artificial Sequence
  synthetic [barcode part1]
aaggtaaggtgagacc

SEQ ID NO: 38910 - DNA, 16 bp, Artificial Sequence
  synthetic [barcode part1]
tctaagaccggtcagt

SEQ ID NO: 38911 - DNA, 16 bp, Artificial Sequence
  synthetic [barcode part1]
ttgtccgatctgtctc

SEQ ID NO: 38912 - DNA, 16 bp, Artificial Sequence
  synthetic [barcode part1]
tgtacgtctccagaag

SEQ ID NO: 38913 - DNA, 16 bp, Artificial Sequence
  synthetic [barcode part1]
agacagactcgaagtt

SEQ ID NO: 38914 - DNA, 16 bp, Artificial Sequence
  synthetic [barcode part1]
gtattaacacaccggc

SEQ ID NO: 38915 - DNA, 16 bp, Artificial Sequence
  synthetic [barcode part1]
ataagttccaggcgtc

SEQ ID NO: 38916 - DNA, 16 bp, Artificial Sequence
  synthetic [barcode part1]
ccgattcagactgaac

SEQ ID NO: 38917 - DNA, 16 bp, Artificial Sequence
  synthetic [barcode part1]
ccaagacttgttcact

SEQ ID NO: 38918 - DNA, 16 bp, Artificial Sequence
  synthetic [barcode part1]
aaggcagtccaggtac

SEQ ID NO: 38919 - DNA, 16 bp, Artificial Sequence
  synthetic [barcode part1]
atcacagacagacaac

SEQ ID NO: 38920 - DNA, 16 bp, Artificial Sequence
  synthetic [barcode part1]
gtaagattcacgagtg

SEQ ID NO: 38921 - DNA, 16 bp, Artificial Sequence
  synthetic [barcode part1]
cgccacttattggcgt

SEQ ID NO: 38922 - DNA, 16 bp, Artificial Sequence
  synthetic [barcode part1]
attcgagactccgtcc

SEQ ID NO: 38923 - DNA, 16 bp, Artificial Sequence
  synthetic [barcode part1]
taggtggaggccttag

SEQ ID NO: 38924 - DNA, 16 bp, Artificial Sequence
  synthetic [barcode part1]
ttagtcgcgactaacg

SEQ ID NO: 38925 - DNA, 16 bp, Artificial Sequence
  synthetic [barcode part1]
caatattacctgtccg

SEQ ID NO: 38926 - DNA, 16 bp, Artificial Sequence
  synthetic [barcode part1]
cgtccgatcctatcag

SEQ ID NO: 38927 - DNA, 16 bp, Artificial Sequence
  synthetic [barcode part1]
tggaggaacgccaatc

SEQ ID NO: 38928 - DNA, 16 bp, Artificial Sequence
  synthetic [barcode part1]
taacgacgccaagttc

SEQ ID NO: 38929 - DNA, 16 bp, Artificial Sequence
  synthetic [barcode part1]
tgcctacgaataggtc

SEQ ID NO: 38930 - DNA, 16 bp, Artificial Sequence
  synthetic [barcode part1]
tactgttggatcggac

SEQ ID NO: 38931 - DNA, 16 bp, Artificial Sequence
  synthetic [barcode part1]
cgaactacttcgtatc

SEQ ID NO: 38932 - DNA, 16 bp, Artificial Sequence
  synthetic [barcode part1]
tccttctacgtgtgtc

SEQ ID NO: 38933 - DNA, 16 bp, Artificial Sequence
  synthetic [barcode part1]
caacgatagaagtacc

SEQ ID NO: 38934 - DNA, 16 bp, Artificial Sequence
  synthetic [barcode part1]
taggtcgtgcgtctct

SEQ ID NO: 38935 - DNA, 16 bp, Artificial Sequence
  synthetic [barcode part1]
tccgttgacgtagtcc

SEQ ID NO: 38936 - DNA, 16 bp, Artificial Sequence
  synthetic [barcode part1]
gccaatactgcacaac

SEQ ID NO: 38937 - DNA, 16 bp, Artificial Sequence
  synthetic [barcode part1]
acgcgatcacagttgt

SEQ ID NO: 38938 - DNA, 16 bp, Artificial Sequence
  synthetic [barcode part1]
cggtgatattgtcggt

SEQ ID NO: 38939 - DNA, 16 bp, Artificial Sequence
  synthetic [barcode part1]
tgaagatcaggtcgcg

SEQ ID NO: 38940 - DNA, 16 bp, Artificial Sequence
  synthetic [barcode part1]
gtgaccagtgtcaact

SEQ ID NO: 38941 - DNA, 16 bp, Artificial Sequence
  synthetic [barcode part1]
gcagtgtcgtatacgt

SEQ ID NO: 38942 - DNA, 16 bp, Artificial Sequence
  synthetic [barcode part1]
attgagatctcggtcg

SEQ ID NO: 38943 - DNA, 16 bp, Artificial Sequence
  synthetic [barcode part1]
tgtctagagaacagtg

SEQ ID NO: 38944 - DNA, 16 bp, Artificial Sequence
  synthetic [barcode part1]
agtggactgtcgtgag

SEQ ID NO: 38945 - DNA, 16 bp, Artificial Sequence
  synthetic [barcode part1]
agagagtcgaatctgt

SEQ ID NO: 38946 - DNA, 16 bp, Artificial Sequence
  synthetic [barcode part1]
gccacaacgttcgtct

SEQ ID NO: 38947 - DNA, 16 bp, Artificial Sequence
  synthetic [barcode part1]
cctatcacttcgtcgt

SEQ ID NO: 38948 - DNA, 16 bp, Artificial Sequence
  synthetic [barcode part1]
tgttggtccaactccg

SEQ ID NO: 38949 - DNA, 16 bp, Artificial Sequence
  synthetic [barcode part1]
cacgtgacgtctcgtt

SEQ ID NO: 38950 - DNA, 16 bp, Artificial Sequence
  synthetic [barcode part1]
acgttaagaggtggtt

SEQ ID NO: 38951 - DNA, 16 bp, Artificial Sequence
  synthetic [barcode part1]
gtcgaacagactacct

SEQ ID NO: 38952 - DNA, 16 bp, Artificial Sequence
  synthetic [barcode part1]
tgccggttcaactctg

SEQ ID NO: 38953 - DNA, 16 bp, Artificial Sequence
  synthetic [barcode part1]
caagtgcgaccgtatt

SEQ ID NO: 38954 - DNA, 16 bp, Artificial Sequence
  synthetic [barcode part1]
cgcacttcagatcacc

SEQ ID NO: 38955 - DNA, 16 bp, Artificial Sequence
  synthetic [barcode part1]
ttactggtcctatacg

SEQ ID NO: 38956 - DNA, 16 bp, Artificial Sequence
  synthetic [barcode part1]
ataagaccgaacactg

SEQ ID NO: 38957 - DNA, 16 bp, Artificial Sequence
  synthetic [barcode part1]
gtcaccgtgtattccg

SEQ ID NO: 38958 - DNA, 16 bp, Artificial Sequence
  synthetic [barcode part1]
cgttaacaactgagag

SEQ ID NO: 38959 - DNA, 16 bp, Artificial Sequence
  synthetic [barcode part1]
gcgccaacaacagaac

SEQ ID NO: 38960 - DNA, 16 bp, Artificial Sequence
  synthetic [barcode part1]
tgcggaagattgttag

SEQ ID NO: 38961 - DNA, 16 bp, Artificial Sequence
  synthetic [barcode part1]
gtcttcgcgttcttac

SEQ ID NO: 38962 - DNA, 16 bp, Artificial Sequence
  synthetic [barcode part1]
aggcgagtaaggcctt

SEQ ID NO: 38963 - DNA, 16 bp, Artificial Sequence
  synthetic [barcode part1]
ccagttcgtctggatc

SEQ ID NO: 38964 - DNA, 16 bp, Artificial Sequence
  synthetic [barcode part1]
aactgtgacgtcagtc

SEQ ID NO: 38965 - DNA, 16 bp, Artificial Sequence
  synthetic [barcode part1]
accaactctaaccgag

SEQ ID NO: 38966 - DNA, 16 bp, Artificial Sequence
  synthetic [barcode part1]
attgtcctcgcaagtt

SEQ ID NO: 38967 - DNA, 16 bp, Artificial Sequence
  synthetic [barcode part1]
ccacaatctggaactg

SEQ ID NO: 38968 - DNA, 16 bp, Artificial Sequence
  synthetic [barcode part1]
tacaggcctgttccgt

SEQ ID NO: 38969 - DNA, 16 bp, Artificial Sequence
  synthetic [barcode part1]
acctaaggtcttactc

SEQ ID NO: 38970 - DNA, 16 bp, Artificial Sequence
  synthetic [barcode part1]
actgacaataagacgc

SEQ ID NO: 38971 - DNA, 16 bp, Artificial Sequence
  synthetic [barcode part1]
cactcaataacgagag

SEQ ID NO: 38972 - DNA, 16 bp, Artificial Sequence
  synthetic [barcode part1]
tgttcacttgcggcgt

SEQ ID NO: 38973 - DNA, 16 bp, Artificial Sequence
  synthetic [barcode part1]
tgtatagtcacgcggt

SEQ ID NO: 38974 - DNA, 16 bp, Artificial Sequence
  synthetic [barcode part1]
tgatcggttgaggtct

SEQ ID NO: 38975 - DNA, 16 bp, Artificial Sequence
  synthetic [barcode part1]
atcacggcacttatct

SEQ ID NO: 38976 - DNA, 16 bp, Artificial Sequence
  synthetic [barcode part1]
aatctctctggcgcac

SEQ ID NO: 38977 - DNA, 16 bp, Artificial Sequence
  synthetic [barcode part1]
aactgtaccaggaagt

SEQ ID NO: 38978 - DNA, 16 bp, Artificial Sequence
  synthetic [barcode part1]
acctgaatcacgagtc

SEQ ID NO: 38979 - DNA, 16 bp, Artificial Sequence
  synthetic [barcode part1]
agatactcaccacctt

SEQ ID NO: 38980 - DNA, 16 bp, Artificial Sequence
  synthetic [barcode part1]
ttcgtgagagttcacg

SEQ ID NO: 38981 - DNA, 16 bp, Artificial Sequence
  synthetic [barcode part1]
agtgtgcaatccttct

SEQ ID NO: 38982 - DNA, 16 bp, Artificial Sequence
  synthetic [barcode part1]
cactattgtggttgtc

SEQ ID NO: 38983 - DNA, 16 bp, Artificial Sequence
  synthetic [barcode part1]
tgtagaccaccgtctc

SEQ ID NO: 38984 - DNA, 16 bp, Artificial Sequence
  synthetic [barcode part1]
gtactagacgttcgac

SEQ ID NO: 38985 - DNA, 16 bp, Artificial Sequence
  synthetic [barcode part1]
tgcagtgtcgcctgtt

SEQ ID NO: 38986 - DNA, 16 bp, Artificial Sequence
  synthetic [barcode part1]
cactagatctgtactc

SEQ ID NO: 38987 - DNA, 16 bp, Artificial Sequence
  synthetic [barcode part1]
actcactacggcgtct

SEQ ID NO: 38988 - DNA, 16 bp, Artificial Sequence
  synthetic [barcode part1]
tcgaggtcgtctgtct

SEQ ID NO: 38989 - DNA, 16 bp, Artificial Sequence
  synthetic [barcode part1]
acaggtcgtattcggt

SEQ ID NO: 38990 - DNA, 16 bp, Artificial Sequence
  synthetic [barcode part1]
tggccttactaacgcc

SEQ ID NO: 38991 - DNA, 16 bp, Artificial Sequence
  synthetic [barcode part1]
aactacggaggagtcc

SEQ ID NO: 38992 - DNA, 16 bp, Artificial Sequence
  synthetic [barcode part1]
atacggtgcactgatc

SEQ ID NO: 38993 - DNA, 16 bp, Artificial Sequence
  synthetic [barcode part1]
cctcaatcacgccagt

SEQ ID NO: 38994 - DNA, 16 bp, Artificial Sequence
  synthetic [barcode part1]
accagactctacgcct

SEQ ID NO: 38995 - DNA, 16 bp, Artificial Sequence
  synthetic [barcode part1]
gtcacaagaataggtc

SEQ ID NO: 38996 - DNA, 16 bp, Artificial Sequence
  synthetic [barcode part1]
cgatctcgattctctc

SEQ ID NO: 38997 - DNA, 16 bp, Artificial Sequence
  synthetic [barcode part1]
cgcctattgttgtaac

SEQ ID NO: 38998 - DNA, 16 bp, Artificial Sequence
  synthetic [barcode part1]
gtagaggttggcagtc

SEQ ID NO: 38999 - DNA, 16 bp, Artificial Sequence
  synthetic [barcode part1]
acgtcaagtgcagttc

SEQ ID NO: 39000 - DNA, 16 bp, Artificial Sequence
  synthetic [barcode part1]
attagatcactctcgc

SEQ ID NO: 39001 - DNA, 16 bp, Artificial Sequence
  synthetic [barcode part1]
aagtcaccttgtactc

SEQ ID NO: 39002 - DNA, 16 bp, Artificial Sequence
  synthetic [barcode part1]
attctatccgtcgcct

SEQ ID NO: 39003 - DNA, 16 bp, Artificial Sequence
  synthetic [barcode part1]
cacgtggttatcgtcc

SEQ ID NO: 39004 - DNA, 16 bp, Artificial Sequence
  synthetic [barcode part1]
gtgtatacgcgtgtgt

SEQ ID NO: 39005 - DNA, 16 bp, Artificial Sequence
  synthetic [barcode part1]
ccacctggacactact

SEQ ID NO: 39006 - DNA, 16 bp, Artificial Sequence
  synthetic [barcode part1]
atccttacgaatcacc

SEQ ID NO: 39007 - DNA, 16 bp, Artificial Sequence
  synthetic [barcode part1]
gtgttgagaaggttac

SEQ ID NO: 39008 - DNA, 16 bp, Artificial Sequence
  synthetic [barcode part1]
cgttgagttcagtggt

SEQ ID NO: 39009 - DNA, 16 bp, Artificial Sequence
  synthetic [barcode part1]
gagttgttactggacc

SEQ ID NO: 39010 - DNA, 16 bp, Artificial Sequence
  synthetic [barcode part1]
ttcgccgttcttgact

SEQ ID NO: 39011 - DNA, 16 bp, Artificial Sequence
  synthetic [barcode part1]
aaggttcggacagacc

SEQ ID NO: 39012 - DNA, 16 bp, Artificial Sequence
  synthetic [barcode part1]
cggttcttgcacgatc

SEQ ID NO: 39013 - DNA, 16 bp, Artificial Sequence
  synthetic [barcode part1]
tgcggattggagtggt

SEQ ID NO: 39014 - DNA, 16 bp, Artificial Sequence
  synthetic [barcode part1]
gtaggtccacgttagt

SEQ ID NO: 39015 - DNA, 16 bp, Artificial Sequence
  synthetic [barcode part1]
tcaagtgcctgtcacc

SEQ ID NO: 39016 - DNA, 16 bp, Artificial Sequence
  synthetic [barcode part1]
taaccgtgtgaggcag

SEQ ID NO: 39017 - DNA, 16 bp, Artificial Sequence
  synthetic [barcode part1]
cgataggccacaagtg

SEQ ID NO: 39018 - DNA, 16 bp, Artificial Sequence
  synthetic [barcode part1]
agtccaactagactgc

SEQ ID NO: 39019 - DNA, 16 bp, Artificial Sequence
  synthetic [barcode part1]
cgacaattgcgtcctc

SEQ ID NO: 39020 - DNA, 16 bp, Artificial Sequence
  synthetic [barcode part1]
atcacttcgaacgttc

SEQ ID NO: 39021 - DNA, 16 bp, Artificial Sequence
  synthetic [barcode part1]
acggcacaacttcaac

SEQ ID NO: 39022 - DNA, 16 bp, Artificial Sequence
  synthetic [barcode part1]
gatctgacgtattctc

SEQ ID NO: 39023 - DNA, 16 bp, Artificial Sequence
  synthetic [barcode part1]
tgatcacgtctaggtg

SEQ ID NO: 39024 - DNA, 16 bp, Artificial Sequence
  synthetic [barcode part1]
aacgaggtacgttaac

SEQ ID NO: 39025 - DNA, 16 bp, Artificial Sequence
  synthetic [barcode part1]
gacgacaattctaccg

SEQ ID NO: 39026 - DNA, 16 bp, Artificial Sequence
  synthetic [barcode part1]
gtcttcgtctggcaac

SEQ ID NO: 39027 - DNA, 16 bp, Artificial Sequence
  synthetic [barcode part1]
cgatctcgttacacgc

SEQ ID NO: 39028 - DNA, 16 bp, Artificial Sequence
  synthetic [barcode part1]
gttattcacaggttcc

SEQ ID NO: 39029 - DNA, 16 bp, Artificial Sequence
  synthetic [barcode part1]
acttcgagtgtgtgtg

SEQ ID NO: 39030 - DNA, 16 bp, Artificial Sequence
  synthetic [barcode part1]
gtggatcttaacgcgt

SEQ ID NO: 39031 - DNA, 16 bp, Artificial Sequence
  synthetic [barcode part1]
acggcacctaatcaac

SEQ ID NO: 39032 - DNA, 16 bp, Artificial Sequence
  synthetic [barcode part1]
aataggaccgacgcac

SEQ ID NO: 39033 - DNA, 16 bp, Artificial Sequence
  synthetic [barcode part1]
gaggcaattcaggtgc

SEQ ID NO: 39034 - DNA, 16 bp, Artificial Sequence
  synthetic [barcode part1]
gaggacgaacacaagt

SEQ ID NO: 39035 - DNA, 16 bp, Artificial Sequence
  synthetic [barcode part1]
agtcggactgtgcaag

SEQ ID NO: 39036 - DNA, 16 bp, Artificial Sequence
  synthetic [barcode part1]
tccttgaggtcctctt

SEQ ID NO: 39037 - DNA, 16 bp, Artificial Sequence
  synthetic [barcode part1]
aagtctgaacacgtcc

SEQ ID NO: 39038 - DNA, 16 bp, Artificial Sequence
  synthetic [barcode part1]
caggcaagaacctcag

SEQ ID NO: 39039 - DNA, 16 bp, Artificial Sequence
  synthetic [barcode part1]
acaaggcgtaacgaag

SEQ ID NO: 39040 - DNA, 16 bp, Artificial Sequence
  synthetic [barcode part1]
gcaactacgcacaatc

SEQ ID NO: 39041 - DNA, 16 bp, Artificial Sequence
  synthetic [barcode part1]
acgtcttcggcgactt

SEQ ID NO: 39042 - DNA, 16 bp, Artificial Sequence
  synthetic [barcode part1]
cgtcggttagttacag

SEQ ID NO: 39043 - DNA, 16 bp, Artificial Sequence
  synthetic [barcode part1]
gactgcagttgacact

SEQ ID NO: 39044 - DNA, 16 bp, Artificial Sequence
  synthetic [barcode part1]
aaggagtctcgtaagt

SEQ ID NO: 39045 - DNA, 16 bp, Artificial Sequence
  synthetic [barcode part1]
aatcgtgtcaatcctc

SEQ ID NO: 39046 - DNA, 16 bp, Artificial Sequence
  synthetic [barcode part1]
actgcgaactccaagt

SEQ ID NO: 39047 - DNA, 16 bp, Artificial Sequence
  synthetic [barcode part1]
gtatcagtcttgtcac

SEQ ID NO: 39048 - DNA, 16 bp, Artificial Sequence
  synthetic [barcode part1]
aacaccactaggatcc

SEQ ID NO: 39049 - DNA, 16 bp, Artificial Sequence
  synthetic [barcode part1]
ttaattgaccgcggtg

SEQ ID NO: 39050 - DNA, 16 bp, Artificial Sequence
  synthetic [barcode part1]
ttggcaggacgcaagt

SEQ ID NO: 39051 - DNA, 16 bp, Artificial Sequence
  synthetic [barcode part1]
atctggagagtggcac

SEQ ID NO: 39052 - DNA, 16 bp, Artificial Sequence
  synthetic [barcode part1]
actcaagtctagacgc

SEQ ID NO: 39053 - DNA, 16 bp, Artificial Sequence
  synthetic [barcode part1]
agacaagttacgacgt

SEQ ID NO: 39054 - DNA, 16 bp, Artificial Sequence
  synthetic [barcode part1]
tctacgtatcggatct

SEQ ID NO: 39055 - DNA, 16 bp, Artificial Sequence
  synthetic [barcode part1]
tgtgacagtaggtggc

SEQ ID NO: 39056 - DNA, 16 bp, Artificial Sequence
  synthetic [barcode part1]
ttgacggcgagttact

SEQ ID NO: 39057 - DNA, 16 bp, Artificial Sequence
  synthetic [barcode part1]
acctccgtgttggact

SEQ ID NO: 39058 - DNA, 16 bp, Artificial Sequence
  synthetic [barcode part1]
ttatcgttctgaacgc

SEQ ID NO: 39059 - DNA, 16 bp, Artificial Sequence
  synthetic [barcode part1]
gaactaccgagttgtc

SEQ ID NO: 39060 - DNA, 16 bp, Artificial Sequence
  synthetic [barcode part1]
tagttaggtcgcggtt

SEQ ID NO: 39061 - DNA, 16 bp, Artificial Sequence
  synthetic [barcode part1]
cggtcctatactgatt

SEQ ID NO: 39062 - DNA, 16 bp, Artificial Sequence
  synthetic [barcode part1]
gtgtgacacaccagtt

SEQ ID NO: 39063 - DNA, 16 bp, Artificial Sequence
  synthetic [barcode part1]
tattgcgtagtcgacg

SEQ ID NO: 39064 - DNA, 16 bp, Artificial Sequence
  synthetic [barcode part1]
gtcctactccaacttc

SEQ ID NO: 39065 - DNA, 16 bp, Artificial Sequence
  synthetic [barcode part1]
tacagactgaggtggc

SEQ ID NO: 39066 - DNA, 16 bp, Artificial Sequence
  synthetic [barcode part1]
tacgaacgtcctgtcc

SEQ ID NO: 39067 - DNA, 16 bp, Artificial Sequence
  synthetic [barcode part1]
tgtgtacgatcaaccg

SEQ ID NO: 39068 - DNA, 16 bp, Artificial Sequence
  synthetic [barcode part1]
aggcagacgaatagac

SEQ ID NO: 39069 - DNA, 16 bp, Artificial Sequence
  synthetic [barcode part1]
aggtgacaaccacacg

SEQ ID NO: 39070 - DNA, 16 bp, Artificial Sequence
  synthetic [barcode part1]
ttgatcgtcgaggttg

SEQ ID NO: 39071 - DNA, 16 bp, Artificial Sequence
  synthetic [barcode part1]
aggtcgagtacaccag

SEQ ID NO: 39072 - DNA, 16 bp, Artificial Sequence
  synthetic [barcode part1]
aggagtagtggagact

SEQ ID NO: 39073 - DNA, 16 bp, Artificial Sequence
  synthetic [barcode part1]
tgattctaaccgaggc

SEQ ID NO: 39074 - DNA, 16 bp, Artificial Sequence
  synthetic [barcode part1]
tgaatcggcgcagaac

SEQ ID NO: 39075 - DNA, 16 bp, Artificial Sequence
  synthetic [barcode part1]
tgttgtgtgactgacg

SEQ ID NO: 39076 - DNA, 16 bp, Artificial Sequence
  synthetic [barcode part1]
tccttgcacaacttag

SEQ ID NO: 39077 - DNA, 16 bp, Artificial Sequence
  synthetic [barcode part1]
acaacgtcaacgtcac

SEQ ID NO: 39078 - DNA, 16 bp, Artificial Sequence
  synthetic [barcode part1]
gaggccttgttgtaac

SEQ ID NO: 39079 - DNA, 16 bp, Artificial Sequence
  synthetic [barcode part1]
cgaatcgtgcactcct

SEQ ID NO: 39080 - DNA, 16 bp, Artificial Sequence
  synthetic [barcode part1]
ttcagagacgcgtatc

SEQ ID NO: 39081 - DNA, 16 bp, Artificial Sequence
  synthetic [barcode part1]
aagtgttgtcctacct

SEQ ID NO: 39082 - DNA, 16 bp, Artificial Sequence
  synthetic [barcode part1]
aacttctaaccgtacc

SEQ ID NO: 39083 - DNA, 16 bp, Artificial Sequence
  synthetic [barcode part1]
gttgttgagaacacag

SEQ ID NO: 39084 - DNA, 16 bp, Artificial Sequence
  synthetic [barcode part1]
gtgtaacctctccgac

SEQ ID NO: 39085 - DNA, 16 bp, Artificial Sequence
  synthetic [barcode part1]
gttcgtacaactcttg

SEQ ID NO: 39086 - DNA, 16 bp, Artificial Sequence
  synthetic [barcode part1]
gtcgtccgacacttgt

SEQ ID NO: 39087 - DNA, 16 bp, Artificial Sequence
  synthetic [barcode part1]
gtagtcggaagtcggt

SEQ ID NO: 39088 - DNA, 16 bp, Artificial Sequence
  synthetic [barcode part1]
ttggatcctccacacg

SEQ ID NO: 39089 - DNA, 16 bp, Artificial Sequence
  synthetic [barcode part1]
ccagtcctgaggaatt

SEQ ID NO: 39090 - DNA, 16 bp, Artificial Sequence
  synthetic [barcode part1]
acttgttccactcacc

SEQ ID NO: 39091 - DNA, 16 bp, Artificial Sequence
  synthetic [barcode part1]
tcactcgcgtcacaac

SEQ ID NO: 39092 - DNA, 16 bp, Artificial Sequence
  synthetic [barcode part1]
aagatcctaccacgac

SEQ ID NO: 39093 - DNA, 16 bp, Artificial Sequence
  synthetic [barcode part1]
gcgttcgttgccttag

SEQ ID NO: 39094 - DNA, 16 bp, Artificial Sequence
  synthetic [barcode part1]
ccttacaccgacgact

SEQ ID NO: 39095 - DNA, 16 bp, Artificial Sequence
  synthetic [barcode part1]
tcttactgcaagtctg

SEQ ID NO: 39096 - DNA, 16 bp, Artificial Sequence
  synthetic [barcode part1]
tacagatcgccgtcct

SEQ ID NO: 39097 - DNA, 16 bp, Artificial Sequence
  synthetic [barcode part1]
gtacgagtcaccagag

SEQ ID NO: 39098 - DNA, 16 bp, Artificial Sequence
  synthetic [barcode part1]
gatcttgactcgcctg

SEQ ID NO: 39099 - DNA, 16 bp, Artificial Sequence
  synthetic [barcode part1]
accgatagacggcaac

SEQ ID NO: 39100 - DNA, 16 bp, Artificial Sequence
  synthetic [barcode part1]
agaccacgcctctgtt

SEQ ID NO: 39101 - DNA, 16 bp, Artificial Sequence
  synthetic [barcode part1]
aagacctcctactcgc

SEQ ID NO: 39102 - DNA, 16 bp, Artificial Sequence
  synthetic [barcode part1]
atcctattgccgacgc

SEQ ID NO: 39103 - DNA, 16 bp, Artificial Sequence
  synthetic [barcode part1]
atccacctctaagatc

SEQ ID NO: 39104 - DNA, 16 bp, Artificial Sequence
  synthetic [barcode part1]
agtgtgtcgattacgc

SEQ ID NO: 39105 - DNA, 16 bp, Artificial Sequence
  synthetic [barcode part1]
atccgttggcaccgtt

SEQ ID NO: 39106 - DNA, 16 bp, Artificial Sequence
  synthetic [barcode part1]
caggatcgttgcagtt

SEQ ID NO: 39107 - DNA, 16 bp, Artificial Sequence
  synthetic [barcode part1]
tccttggaccaacacc

SEQ ID NO: 39108 - DNA, 16 bp, Artificial Sequence
  synthetic [barcode part1]
tccaacctacgaccac

SEQ ID NO: 39109 - DNA, 16 bp, Artificial Sequence
  synthetic [barcode part1]
tcacctgccacaacac

SEQ ID NO: 39110 - DNA, 16 bp, Artificial Sequence
  synthetic [barcode part1]
caatattggtggacag

SEQ ID NO: 39111 - DNA, 16 bp, Artificial Sequence
  synthetic [barcode part1]
agagtcgccagatacg

SEQ ID NO: 39112 - DNA, 16 bp, Artificial Sequence
  synthetic [barcode part1]
tacttacggtaccgcc

SEQ ID NO: 39113 - DNA, 16 bp, Artificial Sequence
  synthetic [barcode part1]
ttcgatcggagtcagt

SEQ ID NO: 39114 - DNA, 16 bp, Artificial Sequence
  synthetic [barcode part1]
cctatcaccttcggtt

SEQ ID NO: 39115 - DNA, 16 bp, Artificial Sequence
  synthetic [barcode part1]
tcgttcggtctcagac

SEQ ID NO: 39116 - DNA, 16 bp, Artificial Sequence
  synthetic [barcode part1]
tggatcaaggacgcac

SEQ ID NO: 39117 - DNA, 16 bp, Artificial Sequence
  synthetic [barcode part1]
ataggtccgacaaggc

SEQ ID NO: 39118 - DNA, 16 bp, Artificial Sequence
  synthetic [barcode part1]
actcgtatcgacgtag

SEQ ID NO: 39119 - DNA, 16 bp, Artificial Sequence
  synthetic [barcode part1]
gaccacagttggtact

SEQ ID NO: 39120 - DNA, 16 bp, Artificial Sequence
  synthetic [barcode part1]
cgaattctccggatag

SEQ ID NO: 39121 - DNA, 16 bp, Artificial Sequence
  synthetic [barcode part1]
caatacctgaacagag

SEQ ID NO: 39122 - DNA, 16 bp, Artificial Sequence
  synthetic [barcode part1]
atccactcgccgtagt

SEQ ID NO: 39123 - DNA, 16 bp, Artificial Sequence
  synthetic [barcode part1]
agacttggttcttcac

SEQ ID NO: 39124 - DNA, 16 bp, Artificial Sequence
  synthetic [barcode part1]
gccagtgatctaagtc

SEQ ID NO: 39125 - DNA, 16 bp, Artificial Sequence
  synthetic [barcode part1]
gttgtctgatactcgt

SEQ ID NO: 39126 - DNA, 16 bp, Artificial Sequence
  synthetic [barcode part1]
tcagataacggtaggt

SEQ ID NO: 39127 - DNA, 16 bp, Artificial Sequence
  synthetic [barcode part1]
tcgcgcaatacactag

SEQ ID NO: 39128 - DNA, 16 bp, Artificial Sequence
  synthetic [barcode part1]
cacagtaggacggatc

SEQ ID NO: 39129 - DNA, 16 bp, Artificial Sequence
  synthetic [barcode part1]
ttatctcaccggagag

SEQ ID NO: 39130 - DNA, 16 bp, Artificial Sequence
  synthetic [barcode part1]
gagaccacacagactg

SEQ ID NO: 39131 - DNA, 16 bp, Artificial Sequence
  synthetic [barcode part1]
caccagattgtgttct

SEQ ID NO: 39132 - DNA, 16 bp, Artificial Sequence
  synthetic [barcode part1]
tgccaccgcctgaatt

SEQ ID NO: 39133 - DNA, 16 bp, Artificial Sequence
  synthetic [barcode part1]
gagttgtcctgcactc

SEQ ID NO: 39134 - DNA, 16 bp, Artificial Sequence
  synthetic [barcode part1]
gattctgttcgttcag

SEQ ID NO: 39135 - DNA, 16 bp, Artificial Sequence
  synthetic [barcode part1]
caacgagtattgcctg

SEQ ID NO: 39136 - DNA, 16 bp, Artificial Sequence
  synthetic [barcode part1]
gtgacgtagtcaacct

SEQ ID NO: 39137 - DNA, 16 bp, Artificial Sequence
  synthetic [barcode part1]
taggtctctacgaacg

SEQ ID NO: 39138 - DNA, 16 bp, Artificial Sequence
  synthetic [barcode part1]
tatcttggacgttcac

SEQ ID NO: 39139 - DNA, 16 bp, Artificial Sequence
  synthetic [barcode part1]
aactgtcctcaacgag

SEQ ID NO: 39140 - DNA, 16 bp, Artificial Sequence
  synthetic [barcode part1]
tctggcgttgtgttcg

SEQ ID NO: 39141 - DNA, 16 bp, Artificial Sequence
  synthetic [barcode part1]
aggttactgccaagtc

SEQ ID NO: 39142 - DNA, 16 bp, Artificial Sequence
  synthetic [barcode part1]
gaactactgaaggcgc

SEQ ID NO: 39143 - DNA, 16 bp, Artificial Sequence
  synthetic [barcode part1]
tggccagtacaatacc

SEQ ID NO: 39144 - DNA, 16 bp, Artificial Sequence
  synthetic [barcode part1]
ccaatagaagtcgtcc

SEQ ID NO: 39145 - DNA, 16 bp, Artificial Sequence
  synthetic [barcode part1]
acgacagtgttctgtg

SEQ ID NO: 39146 - DNA, 16 bp, Artificial Sequence
  synthetic [barcode part1]
gatactgcctcttctc

SEQ ID NO: 39147 - DNA, 16 bp, Artificial Sequence
  synthetic [barcode part1]
attcctgttcaacggt

SEQ ID NO: 39148 - DNA, 16 bp, Artificial Sequence
  synthetic [barcode part1]
gtgataaggatacctg

SEQ ID NO: 39149 - DNA, 16 bp, Artificial Sequence
  synthetic [barcode part1]
aacaaccggttcgatc

SEQ ID NO: 39150 - DNA, 16 bp, Artificial Sequence
  synthetic [barcode part1]
ttactaagaaggtgcg

SEQ ID NO: 39151 - DNA, 16 bp, Artificial Sequence
  synthetic [barcode part1]
ataaggacttcacgcc

SEQ ID NO: 39152 - DNA, 16 bp, Artificial Sequence
  synthetic [barcode part1]
cgcaatactgcagtac

SEQ ID NO: 39153 - DNA, 16 bp, Artificial Sequence
  synthetic [barcode part1]
caactggtaacgtcgt

SEQ ID NO: 39154 - DNA, 16 bp, Artificial Sequence
  synthetic [barcode part1]
tccgactgatctcttc

SEQ ID NO: 39155 - DNA, 16 bp, Artificial Sequence
  synthetic [barcode part1]
cgtgttatctcctaag

SEQ ID NO: 39156 - DNA, 16 bp, Artificial Sequence
  synthetic [barcode part1]
gacgtcctaggaagtg

SEQ ID NO: 39157 - DNA, 16 bp, Artificial Sequence
  synthetic [barcode part1]
aatcgtcttgtgttcg

SEQ ID NO: 39158 - DNA, 16 bp, Artificial Sequence
  synthetic [barcode part1]
acttcacgtaaggcgt

SEQ ID NO: 39159 - DNA, 16 bp, Artificial Sequence
  synthetic [barcode part1]
cgagtcgttgatagtc

SEQ ID NO: 39160 - DNA, 16 bp, Artificial Sequence
  synthetic [barcode part1]
tcgtattcctacgtcc

SEQ ID NO: 39161 - DNA, 16 bp, Artificial Sequence
  synthetic [barcode part1]
gtgaccgtagtgtatc

SEQ ID NO: 39162 - DNA, 16 bp, Artificial Sequence
  synthetic [barcode part1]
tcctcacgttcttgtg

SEQ ID NO: 39163 - DNA, 16 bp, Artificial Sequence
  synthetic [barcode part1]
aacggttaccagatcc

SEQ ID NO: 39164 - DNA, 16 bp, Artificial Sequence
  synthetic [barcode part1]
atcaccacctctatag

SEQ ID NO: 39165 - DNA, 16 bp, Artificial Sequence
  synthetic [barcode part1]
cgttctgaccttgttc

SEQ ID NO: 39166 - DNA, 16 bp, Artificial Sequence
  synthetic [barcode part1]
taagtccagacggcag

SEQ ID NO: 39167 - DNA, 16 bp, Artificial Sequence
  synthetic [barcode part1]
gtccggatctgttacc

SEQ ID NO: 39168 - DNA, 16 bp, Artificial Sequence
  synthetic [barcode part1]
ttctagtctctaccgc

SEQ ID NO: 39169 - DNA, 16 bp, Artificial Sequence
  synthetic [barcode part1]
actctgccagattcgc

SEQ ID NO: 39170 - DNA, 16 bp, Artificial Sequence
  synthetic [barcode part1]
gttcggcgtacaagag

SEQ ID NO: 39171 - DNA, 16 bp, Artificial Sequence
  synthetic [barcode part1]
gacctcttctctgatc

SEQ ID NO: 39172 - DNA, 16 bp, Artificial Sequence
  synthetic [barcode part1]
taacagtcggcgactt

SEQ ID NO: 39173 - DNA, 16 bp, Artificial Sequence
  synthetic [barcode part1]
tgagtatcggtgaagt

SEQ ID NO: 39174 - DNA, 16 bp, Artificial Sequence
  synthetic [barcode part1]
gattgcgtctcttagt

SEQ ID NO: 39175 - DNA, 16 bp, Artificial Sequence
  synthetic [barcode part1]
tctagttctggccttc

SEQ ID NO: 39176 - DNA, 16 bp, Artificial Sequence
  synthetic [barcode part1]
ttattcgaacaccgtc

SEQ ID NO: 39177 - DNA, 16 bp, Artificial Sequence
  synthetic [barcode part1]
tgaatacggtcgcact

SEQ ID NO: 39178 - DNA, 16 bp, Artificial Sequence
  synthetic [barcode part1]
agtaatcgaaggcact

SEQ ID NO: 39179 - DNA, 16 bp, Artificial Sequence
  synthetic [barcode part1]
gtgagacacgaacctg

SEQ ID NO: 39180 - DNA, 16 bp, Artificial Sequence
  synthetic [barcode part1]
ttatctcaaggcggtg

SEQ ID NO: 39181 - DNA, 16 bp, Artificial Sequence
  synthetic [barcode part1]
cgtgcgtgtattgtag

SEQ ID NO: 39182 - DNA, 16 bp, Artificial Sequence
  synthetic [barcode part1]
gttcgttgcgagtagt

SEQ ID NO: 39183 - DNA, 16 bp, Artificial Sequence
  synthetic [barcode part1]
aggcgttcactcaagt

SEQ ID NO: 39184 - DNA, 16 bp, Artificial Sequence
  synthetic [barcode part1]
gttccacacttagatc

SEQ ID NO: 39185 - DNA, 16 bp, Artificial Sequence
  synthetic [barcode part1]
gatccttgcacttagt

SEQ ID NO: 39186 - DNA, 16 bp, Artificial Sequence
  synthetic [barcode part1]
cgttagagacgtggac

SEQ ID NO: 39187 - DNA, 16 bp, Artificial Sequence
  synthetic [barcode part1]
ttgaacgtaggtgtcc

SEQ ID NO: 39188 - DNA, 16 bp, Artificial Sequence
  synthetic [barcode part1]
ttcgtccgcaatattg

SEQ ID NO: 39189 - DNA, 16 bp, Artificial Sequence
  synthetic [barcode part1]
acgatcaccttgattc

SEQ ID NO: 39190 - DNA, 16 bp, Artificial Sequence
  synthetic [barcode part1]
tacgttcctactgagt

SEQ ID NO: 39191 - DNA, 16 bp, Artificial Sequence
  synthetic [barcode part1]
aagtccgaataacggt

SEQ ID NO: 39192 - DNA, 16 bp, Artificial Sequence
  synthetic [barcode part1]
tgtcctcacgtaagag

SEQ ID NO: 39193 - DNA, 16 bp, Artificial Sequence
  synthetic [barcode part1]
atacgcggttgactgt

SEQ ID NO: 39194 - DNA, 16 bp, Artificial Sequence
  synthetic [barcode part1]
gacgcgttacaattgc

SEQ ID NO: 39195 - DNA, 16 bp, Artificial Sequence
  synthetic [barcode part1]
ttctcctaccgattgc

SEQ ID NO: 39196 - DNA, 16 bp, Artificial Sequence
  synthetic [barcode part1]
accagtataccagtgc

SEQ ID NO: 39197 - DNA, 16 bp, Artificial Sequence
  synthetic [barcode part1]
tatcgacaggaagttg

SEQ ID NO: 39198 - DNA, 16 bp, Artificial Sequence
  synthetic [barcode part1]
ccactcggagtgaatt

SEQ ID NO: 39199 - DNA, 16 bp, Artificial Sequence
  synthetic [barcode part1]
agatagattcgagacc

SEQ ID NO: 39200 - DNA, 16 bp, Artificial Sequence
  synthetic [barcode part1]
tgatcgttctgatctg

SEQ ID NO: 39201 - DNA, 16 bp, Artificial Sequence
  synthetic [barcode part1]
tcaccgtgtgaactcc

SEQ ID NO: 39202 - DNA, 16 bp, Artificial Sequence
  synthetic [barcode part1]
agtactgtggtcaacc

SEQ ID NO: 39203 - DNA, 16 bp, Artificial Sequence
  synthetic [barcode part1]
cgtagattcacctcgc

SEQ ID NO: 39204 - DNA, 16 bp, Artificial Sequence
  synthetic [barcode part1]
atcagaatacggtcag

SEQ ID NO: 39205 - DNA, 16 bp, Artificial Sequence
  synthetic [barcode part1]
atcacttaggttcacc

SEQ ID NO: 39206 - DNA, 16 bp, Artificial Sequence
  synthetic [barcode part1]
gttacttggatctgtc

SEQ ID NO: 39207 - DNA, 16 bp, Artificial Sequence
  synthetic [barcode part1]
gaatcaaggtcggaag

SEQ ID NO: 39208 - DNA, 16 bp, Artificial Sequence
  synthetic [barcode part1]
acgaaggcggtctaac

SEQ ID NO: 39209 - DNA, 16 bp, Artificial Sequence
  synthetic [barcode part1]
cgactaggtactacgt

SEQ ID NO: 39210 - DNA, 16 bp, Artificial Sequence
  synthetic [barcode part1]
gtggatccagtctcct

SEQ ID NO: 39211 - DNA, 16 bp, Artificial Sequence
  synthetic [barcode part1]
gtacagttcttctgac

SEQ ID NO: 39212 - DNA, 16 bp, Artificial Sequence
  synthetic [barcode part1]
tcacaagagtgcactc

SEQ ID NO: 39213 - DNA, 16 bp, Artificial Sequence
  synthetic [barcode part1]
tgccgttgatacgtcc

SEQ ID NO: 39214 - DNA, 16 bp, Artificial Sequence
  synthetic [barcode part1]
gtcctacgaatcgaac

SEQ ID NO: 39215 - DNA, 16 bp, Artificial Sequence
  synthetic [barcode part1]
atcaaccgtcagtcag

SEQ ID NO: 39216 - DNA, 16 bp, Artificial Sequence
  synthetic [barcode part1]
aagtctgacctgagtc

SEQ ID NO: 39217 - DNA, 16 bp, Artificial Sequence
  synthetic [barcode part1]
acgagaaccggtggtt

SEQ ID NO: 39218 - DNA, 16 bp, Artificial Sequence
  synthetic [barcode part1]
gactgcctactctcag

SEQ ID NO: 39219 - DNA, 16 bp, Artificial Sequence
  synthetic [barcode part1]
acgagaccttactacg

SEQ ID NO: 39220 - DNA, 16 bp, Artificial Sequence
  synthetic [barcode part1]
caaggactgaatcgcg

SEQ ID NO: 39221 - DNA, 16 bp, Artificial Sequence
  synthetic [barcode part1]
cgattccaatcggaac

SEQ ID NO: 39222 - DNA, 16 bp, Artificial Sequence
  synthetic [barcode part1]
gatcgatacacacgtc

SEQ ID NO: 39223 - DNA, 16 bp, Artificial Sequence
  synthetic [barcode part1]
cctacggtaccacttg

SEQ ID NO: 39224 - DNA, 16 bp, Artificial Sequence
  synthetic [barcode part1]
acgaaggaactgccac

SEQ ID NO: 39225 - DNA, 16 bp, Artificial Sequence
  synthetic [barcode part1]
cacgacagtccactct

SEQ ID NO: 39226 - DNA, 16 bp, Artificial Sequence
  synthetic [barcode part1]
agactggttccaactg

SEQ ID NO: 39227 - DNA, 16 bp, Artificial Sequence
  synthetic [barcode part1]
gaataactgcgaatcg

SEQ ID NO: 39228 - DNA, 16 bp, Artificial Sequence
  synthetic [barcode part1]
acgactagtataccgc

SEQ ID NO: 39229 - DNA, 16 bp, Artificial Sequence
  synthetic [barcode part1]
gcgcaactatagtcac

SEQ ID NO: 39230 - DNA, 16 bp, Artificial Sequence
  synthetic [barcode part1]
tgcgattcaattctcg

SEQ ID NO: 39231 - DNA, 16 bp, Artificial Sequence
  synthetic [barcode part1]
tgtagaatcgagtcag

SEQ ID NO: 39232 - DNA, 16 bp, Artificial Sequence
  synthetic [barcode part1]
cctcgcaattggacct

SEQ ID NO: 39233 - DNA, 16 bp, Artificial Sequence
  synthetic [barcode part1]
aatccggatatctcct

SEQ ID NO: 39234 - DNA, 16 bp, Artificial Sequence
  synthetic [barcode part1]
gagagacaggtacctc

SEQ ID NO: 39235 - DNA, 16 bp, Artificial Sequence
  synthetic [barcode part1]
tcactagactgccaag

SEQ ID NO: 39236 - DNA, 16 bp, Artificial Sequence
  synthetic [barcode part1]
caacgacgttactggt

SEQ ID NO: 39237 - DNA, 16 bp, Artificial Sequence
  synthetic [barcode part1]
gcacgacagttggaac

SEQ ID NO: 39238 - DNA, 16 bp, Artificial Sequence
  synthetic [barcode part1]
agacggttgcggattg

SEQ ID NO: 39239 - DNA, 16 bp, Artificial Sequence
  synthetic [barcode part1]
aacgcagtctggcaag

SEQ ID NO: 39240 - DNA, 16 bp, Artificial Sequence
  synthetic [barcode part1]
aagtgcctactgttct

SEQ ID NO: 39241 - DNA, 16 bp, Artificial Sequence
  synthetic [barcode part1]
acaacgttacgcgtac

SEQ ID NO: 39242 - DNA, 16 bp, Artificial Sequence
  synthetic [barcode part1]
gtggcgtaatcgattc

SEQ ID NO: 39243 - DNA, 16 bp, Artificial Sequence
  synthetic [barcode part1]
acctaacactaccgag

SEQ ID NO: 39244 - DNA, 16 bp, Artificial Sequence
  synthetic [barcode part1]
tgcaactctcttagtg

SEQ ID NO: 39245 - DNA, 16 bp, Artificial Sequence
  synthetic [barcode part1]
gcgcggtgaagttagt

SEQ ID NO: 39246 - DNA, 16 bp, Artificial Sequence
  synthetic [barcode part1]
cctctacgtctggtag

SEQ ID NO: 39247 - DNA, 16 bp, Artificial Sequence
  synthetic [barcode part1]
aagtctggttcagacc

SEQ ID NO: 39248 - DNA, 16 bp, Artificial Sequence
  synthetic [barcode part1]
cagagtggtagttgcg

SEQ ID NO: 39249 - DNA, 16 bp, Artificial Sequence
  synthetic [barcode part1]
tggtcagaccacagtt

SEQ ID NO: 39250 - DNA, 16 bp, Artificial Sequence
  synthetic [barcode part1]
gaaggtgttcggcaac

SEQ ID NO: 39251 - DNA, 16 bp, Artificial Sequence
  synthetic [barcode part1]
agtaacttcctcacgt

SEQ ID NO: 39252 - DNA, 16 bp, Artificial Sequence
  synthetic [barcode part1]
tggagttattggccac

SEQ ID NO: 39253 - DNA, 16 bp, Artificial Sequence
  synthetic [barcode part1]
gttctattgccggcac

SEQ ID NO: 39254 - DNA, 16 bp, Artificial Sequence
  synthetic [barcode part1]
aactagaacaaccacg

SEQ ID NO: 39255 - DNA, 16 bp, Artificial Sequence
  synthetic [barcode part1]
gttctgagaggttctg

SEQ ID NO: 39256 - DNA, 16 bp, Artificial Sequence
  synthetic [barcode part1]
aggtgtcgcgacaagt

SEQ ID NO: 39257 - DNA, 16 bp, Artificial Sequence
  synthetic [barcode part1]
actacgttgtgtcgag

SEQ ID NO: 39258 - DNA, 16 bp, Artificial Sequence
  synthetic [barcode part1]
tactcactcgtccact

SEQ ID NO: 39259 - DNA, 16 bp, Artificial Sequence
  synthetic [barcode part1]
acgaaccggttacgtt

SEQ ID NO: 39260 - DNA, 16 bp, Artificial Sequence
  synthetic [barcode part1]
taatccgcaaggatag

SEQ ID NO: 39261 - DNA, 16 bp, Artificial Sequence
  synthetic [barcode part1]
acgtcagtcttcagtt

SEQ ID NO: 39262 - DNA, 16 bp, Artificial Sequence
  synthetic [barcode part1]
ataagtgcgaagtctg

SEQ ID NO: 39263 - DNA, 16 bp, Artificial Sequence
  synthetic [barcode part1]
actgcgcaagaattag

SEQ ID NO: 39264 - DNA, 16 bp, Artificial Sequence
  synthetic [barcode part1]
gcaattgagttcttcc

SEQ ID NO: 39265 - DNA, 16 bp, Artificial Sequence
  synthetic [barcode part1]
atctccacggaccgtt

SEQ ID NO: 39266 - DNA, 16 bp, Artificial Sequence
  synthetic [barcode part1]
ccgattcgaacacctc

SEQ ID NO: 39267 - DNA, 16 bp, Artificial Sequence
  synthetic [barcode part1]
tcctgaaggacagacg

SEQ ID NO: 39268 - DNA, 16 bp, Artificial Sequence
  synthetic [barcode part1]
gtgacactgcaacgtt

SEQ ID NO: 39269 - DNA, 16 bp, Artificial Sequence
  synthetic [barcode part1]
attcgaggtcttactc

SEQ ID NO: 39270 - DNA, 16 bp, Artificial Sequence
  synthetic [barcode part1]
tgttaagacggaggtt

SEQ ID NO: 39271 - DNA, 16 bp, Artificial Sequence
  synthetic [barcode part1]
ccaagagtaacctctg

SEQ ID NO: 39272 - DNA, 16 bp, Artificial Sequence
  synthetic [barcode part1]
tccacggtgaagtgag

SEQ ID NO: 39273 - DNA, 16 bp, Artificial Sequence
  synthetic [barcode part1]
taggttccgttcgaag

SEQ ID NO: 39274 - DNA, 16 bp, Artificial Sequence
  synthetic [barcode part1]
gcagtgcagttagttc

SEQ ID NO: 39275 - DNA, 16 bp, Artificial Sequence
  synthetic [barcode part1]
gtatacctaccgacag

SEQ ID NO: 39276 - DNA, 16 bp, Artificial Sequence
  synthetic [barcode part1]
atacctgagacagtag

SEQ ID NO: 39277 - DNA, 16 bp, Artificial Sequence
  synthetic [barcode part1]
tacctgtactctgagt

SEQ ID NO: 39278 - DNA, 16 bp, Artificial Sequence
  synthetic [barcode part1]
gtaccaagatctgtgc

SEQ ID NO: 39279 - DNA, 16 bp, Artificial Sequence
  synthetic [barcode part1]
accgtgataggcaggt

SEQ ID NO: 39280 - DNA, 16 bp, Artificial Sequence
  synthetic [barcode part1]
tgaagtcgactctgac

SEQ ID NO: 39281 - DNA, 16 bp, Artificial Sequence
  synthetic [barcode part1]
taggcaccgtgaatct

SEQ ID NO: 39282 - DNA, 16 bp, Artificial Sequence
  synthetic [barcode part1]
acagattcttccggtt

SEQ ID NO: 39283 - DNA, 16 bp, Artificial Sequence
  synthetic [barcode part1]
gcgagaacgattcgac

SEQ ID NO: 39284 - DNA, 16 bp, Artificial Sequence
  synthetic [barcode part1]
aacttccgcgtggtct

SEQ ID NO: 39285 - DNA, 16 bp, Artificial Sequence
  synthetic [barcode part1]
acctgtcctacttacc

SEQ ID NO: 39286 - DNA, 16 bp, Artificial Sequence
  synthetic [barcode part1]
actggtatatcctgtc

SEQ ID NO: 39287 - DNA, 16 bp, Artificial Sequence
  synthetic [barcode part1]
gtacgttatccgaacg

SEQ ID NO: 39288 - DNA, 16 bp, Artificial Sequence
  synthetic [barcode part1]
tcaggcaacaacaagt

SEQ ID NO: 39289 - DNA, 16 bp, Artificial Sequence
  synthetic [barcode part1]
gattggtatcgaccac

SEQ ID NO: 39290 - DNA, 16 bp, Artificial Sequence
  synthetic [barcode part1]
ccacctagatattgtc

SEQ ID NO: 39291 - DNA, 16 bp, Artificial Sequence
  synthetic [barcode part1]
gagtacttccgagtac

SEQ ID NO: 39292 - DNA, 16 bp, Artificial Sequence
  synthetic [barcode part1]
gcgcgattcgattctc

SEQ ID NO: 39293 - DNA, 16 bp, Artificial Sequence
  synthetic [barcode part1]
gtcagagttccaatcg

SEQ ID NO: 39294 - DNA, 16 bp, Artificial Sequence
  synthetic [barcode part1]
gacgaactgttcactg

SEQ ID NO: 39295 - DNA, 16 bp, Artificial Sequence
  synthetic [barcode part1]
aagttgcggacgtgac

SEQ ID NO: 39296 - DNA, 16 bp, Artificial Sequence
  synthetic [barcode part1]
atcacttcaccgtctc

SEQ ID NO: 39297 - DNA, 16 bp, Artificial Sequence
  synthetic [barcode part1]
atatacgcctcctcct

SEQ ID NO: 39298 - DNA, 16 bp, Artificial Sequence
  synthetic [barcode part1]
caccaggagtaatctc

SEQ ID NO: 39299 - DNA, 16 bp, Artificial Sequence
  synthetic [barcode part1]
tatcgcaagaggagag

SEQ ID NO: 39300 - DNA, 16 bp, Artificial Sequence
  synthetic [barcode part1]
ccgatcgcgatattag

SEQ ID NO: 39301 - DNA, 16 bp, Artificial Sequence
  synthetic [barcode part1]
gttacagacaggcgac

SEQ ID NO: 39302 - DNA, 16 bp, Artificial Sequence
  synthetic [barcode part1]
attcggttacacttcg

SEQ ID NO: 39303 - DNA, 16 bp, Artificial Sequence
  synthetic [barcode part1]
gttcgtactaggtacg

SEQ ID NO: 39304 - DNA, 16 bp, Artificial Sequence
  synthetic [barcode part1]
aacgcgagaattgccg

SEQ ID NO: 39305 - DNA, 16 bp, Artificial Sequence
  synthetic [barcode part1]
ttgtcgcgcctacaac

SEQ ID NO: 39306 - DNA, 16 bp, Artificial Sequence
  synthetic [barcode part1]
cctaccagtgtggttc

SEQ ID NO: 39307 - DNA, 16 bp, Artificial Sequence
  synthetic [barcode part1]
cagattcgtgaactcg

SEQ ID NO: 39308 - DNA, 16 bp, Artificial Sequence
  synthetic [barcode part1]
aagtccaacaagacac

SEQ ID NO: 39309 - DNA, 16 bp, Artificial Sequence
  synthetic [barcode part1]
gtctcggtaacactag

SEQ ID NO: 39310 - DNA, 16 bp, Artificial Sequence
  synthetic [barcode part1]
acctgcgatacgattg

SEQ ID NO: 39311 - DNA, 16 bp, Artificial Sequence
  synthetic [barcode part1]
aagaggtccgtgtggt

SEQ ID NO: 39312 - DNA, 16 bp, Artificial Sequence
  synthetic [barcode part1]
aacctacctacttcag

SEQ ID NO: 39313 - DNA, 16 bp, Artificial Sequence
  synthetic [barcode part1]
cagaggactaacttcc

SEQ ID NO: 39314 - DNA, 16 bp, Artificial Sequence
  synthetic [barcode part1]
aaccggcaccaattac

SEQ ID NO: 39315 - DNA, 16 bp, Artificial Sequence
  synthetic [barcode part1]
ttctgagtactgcgag

SEQ ID NO: 39316 - DNA, 16 bp, Artificial Sequence
  synthetic [barcode part1]
ccgcgataattccaag

SEQ ID NO: 39317 - DNA, 16 bp, Artificial Sequence
  synthetic [barcode part1]
gcaacgacagacctag

SEQ ID NO: 39318 - DNA, 16 bp, Artificial Sequence
  synthetic [barcode part1]
gatcgtgtcaactctt

SEQ ID NO: 39319 - DNA, 16 bp, Artificial Sequence
  synthetic [barcode part1]
aaggttcaagtagacc

SEQ ID NO: 39320 - DNA, 16 bp, Artificial Sequence
  synthetic [barcode part1]
agttcttgcgcctgac

SEQ ID NO: 39321 - DNA, 16 bp, Artificial Sequence
  synthetic [barcode part1]
tcttcaacgtgtgatc

SEQ ID NO: 39322 - DNA, 16 bp, Artificial Sequence
  synthetic [barcode part1]
gcgttagtgatctctt

SEQ ID NO: 39323 - DNA, 16 bp, Artificial Sequence
  synthetic [barcode part1]
taagtcgtcctatacc

SEQ ID NO: 39324 - DNA, 16 bp, Artificial Sequence
  synthetic [barcode part1]
tacgtaaccgccgtct

SEQ ID NO: 39325 - DNA, 16 bp, Artificial Sequence
  synthetic [barcode part1]
gtacgtacagtaccac

SEQ ID NO: 39326 - DNA, 16 bp, Artificial Sequence
  synthetic [barcode part1]
tggaaccagtctcagt

SEQ ID NO: 39327 - DNA, 16 bp, Artificial Sequence
  synthetic [barcode part1]
gagagtatcactgagt

SEQ ID NO: 39328 - DNA, 16 bp, Artificial Sequence
  synthetic [barcode part1]
agttaaccgtggcgtt

SEQ ID NO: 39329 - DNA, 16 bp, Artificial Sequence
  synthetic [barcode part1]
tggtctattgtacctg

SEQ ID NO: 39330 - DNA, 16 bp, Artificial Sequence
  synthetic [barcode part1]
gatccttacgcaatct

SEQ ID NO: 39331 - DNA, 16 bp, Artificial Sequence
  synthetic [barcode part1]
gagttgtgagtgtaac

SEQ ID NO: 39332 - DNA, 16 bp, Artificial Sequence
  synthetic [barcode part1]
agaccttgattgaccg

SEQ ID NO: 39333 - DNA, 16 bp, Artificial Sequence
  synthetic [barcode part1]
tctctaacgcaactac

SEQ ID NO: 39334 - DNA, 16 bp, Artificial Sequence
  synthetic [barcode part1]
tagttgcgacggcaag

SEQ ID NO: 39335 - DNA, 16 bp, Artificial Sequence
  synthetic [barcode part1]
ttccttactcgtagag

SEQ ID NO: 39336 - DNA, 16 bp, Artificial Sequence
  synthetic [barcode part1]
gataggcctacttacg

SEQ ID NO: 39337 - DNA, 16 bp, Artificial Sequence
  synthetic [barcode part1]
gcgactgaagatcgac

SEQ ID NO: 39338 - DNA, 16 bp, Artificial Sequence
  synthetic [barcode part1]
tggaggtaacgacctg

SEQ ID NO: 39339 - DNA, 16 bp, Artificial Sequence
  synthetic [barcode part1]
ttgtggttgcacacag

SEQ ID NO: 39340 - DNA, 16 bp, Artificial Sequence
  synthetic [barcode part1]
taggtcggattcgact

SEQ ID NO: 39341 - DNA, 16 bp, Artificial Sequence
  synthetic [barcode part1]
aactcaacacgtcctt

SEQ ID NO: 39342 - DNA, 16 bp, Artificial Sequence
  synthetic [barcode part1]
gcagactgtactcagt

SEQ ID NO: 39343 - DNA, 16 bp, Artificial Sequence
  synthetic [barcode part1]
aggaggcctactactt

SEQ ID NO: 39344 - DNA, 16 bp, Artificial Sequence
  synthetic [barcode part1]
cgtctgttgtcgtgac

SEQ ID NO: 39345 - DNA, 16 bp, Artificial Sequence
  synthetic [barcode part1]
ttagtgactcggtggt

SEQ ID NO: 39346 - DNA, 16 bp, Artificial Sequence
  synthetic [barcode part1]
tctctaacacgcggtc

SEQ ID NO: 39347 - DNA, 16 bp, Artificial Sequence
  synthetic [barcode part1]
gacgtatctaacttcc

SEQ ID NO: 39348 - DNA, 16 bp, Artificial Sequence
  synthetic [barcode part1]
cgcactgtgtgattag

SEQ ID NO: 39349 - DNA, 16 bp, Artificial Sequence
  synthetic [barcode part1]
agtggagtgcaagtcc

SEQ ID NO: 39350 - DNA, 16 bp, Artificial Sequence
  synthetic [barcode part1]
tcgtagttctctctcg

SEQ ID NO: 39351 - DNA, 16 bp, Artificial Sequence
  synthetic [barcode part1]
cctcgttcaggtgttg

SEQ ID NO: 39352 - DNA, 16 bp, Artificial Sequence
  synthetic [barcode part1]
accgagtgccttcgtt

SEQ ID NO: 39353 - DNA, 16 bp, Artificial Sequence
  synthetic [barcode part1]
cactgaacctatactc

SEQ ID NO: 39354 - DNA, 16 bp, Artificial Sequence
  synthetic [barcode part1]
tctggcgttcagtaag

SEQ ID NO: 39355 - DNA, 16 bp, Artificial Sequence
  synthetic [barcode part1]
gttggtatcgcgtaac

SEQ ID NO: 39356 - DNA, 16 bp, Artificial Sequence
  synthetic [barcode part1]
aatctaggccgttggt

SEQ ID NO: 39357 - DNA, 16 bp, Artificial Sequence
  synthetic [barcode part1]
gcgcaatccagtctct

SEQ ID NO: 39358 - DNA, 16 bp, Artificial Sequence
  synthetic [barcode part1]
accaaggaggactaag

SEQ ID NO: 39359 - DNA, 16 bp, Artificial Sequence
  synthetic [barcode part1]
acaattactcctcgac

SEQ ID NO: 39360 - DNA, 16 bp, Artificial Sequence
  synthetic [barcode part1]
ttgcgttggactactt

SEQ ID NO: 39361 - DNA, 16 bp, Artificial Sequence
  synthetic [barcode part1]
tcacacctactcttgc

SEQ ID NO: 39362 - DNA, 16 bp, Artificial Sequence
  synthetic [barcode part1]
cacagataagtaacgc

SEQ ID NO: 39363 - DNA, 16 bp, Artificial Sequence
  synthetic [barcode part1]
cgagtcaagtctggtt

SEQ ID NO: 39364 - DNA, 16 bp, Artificial Sequence
  synthetic [barcode part1]
tagtcgacacacgtac

SEQ ID NO: 39365 - DNA, 16 bp, Artificial Sequence
  synthetic [barcode part1]
ttcgccaactatctcc

SEQ ID NO: 39366 - DNA, 16 bp, Artificial Sequence
  synthetic [barcode part1]
tcggcacactaatacg

SEQ ID NO: 39367 - DNA, 16 bp, Artificial Sequence
  synthetic [barcode part1]
gatacaagaattgccg

SEQ ID NO: 39368 - DNA, 16 bp, Artificial Sequence
  synthetic [barcode part1]
gtgttagtcctcgacc

SEQ ID NO: 39369 - DNA, 16 bp, Artificial Sequence
  synthetic [barcode part1]
tcacttgttcgtccgt

SEQ ID NO: 39370 - DNA, 16 bp, Artificial Sequence
  synthetic [barcode part1]
gatatcggtcaactgc

SEQ ID NO: 39371 - DNA, 16 bp, Artificial Sequence
  synthetic [barcode part1]
tacgtggtaagaggtt

SEQ ID NO: 39372 - DNA, 16 bp, Artificial Sequence
  synthetic [barcode part1]
acacggagaattgccg

SEQ ID NO: 39373 - DNA, 16 bp, Artificial Sequence
  synthetic [barcode part1]
gacacagattcggcag

SEQ ID NO: 39374 - DNA, 16 bp, Artificial Sequence
  synthetic [barcode part1]
tgtcagtgttggtgtg

SEQ ID NO: 39375 - DNA, 16 bp, Artificial Sequence
  synthetic [barcode part1]
tctcagattactcacg

SEQ ID NO: 39376 - DNA, 16 bp, Artificial Sequence
  synthetic [barcode part1]
cgtgcagactcttcac

SEQ ID NO: 39377 - DNA, 16 bp, Artificial Sequence
  synthetic [barcode part1]
gcaccacggtaagtag

SEQ ID NO: 39378 - DNA, 16 bp, Artificial Sequence
  synthetic [barcode part1]
cgtgtccgtgaagatt

SEQ ID NO: 39379 - DNA, 16 bp, Artificial Sequence
  synthetic [barcode part1]
actcactgcagtgcct

SEQ ID NO: 39380 - DNA, 16 bp, Artificial Sequence
  synthetic [barcode part1]
aggaattacactggtg

SEQ ID NO: 39381 - DNA, 16 bp, Artificial Sequence
  synthetic [barcode part1]
acgcgtagtcacaact

SEQ ID NO: 39382 - DNA, 16 bp, Artificial Sequence
  synthetic [barcode part1]
tcgattctactggtgt

SEQ ID NO: 39383 - DNA, 16 bp, Artificial Sequence
  synthetic [barcode part1]
ttgtcttgatcacacg

SEQ ID NO: 39384 - DNA, 16 bp, Artificial Sequence
  synthetic [barcode part1]
cgttgccacttagatt

SEQ ID NO: 39385 - DNA, 16 bp, Artificial Sequence
  synthetic [barcode part1]
cgtaacaatccgcctc

SEQ ID NO: 39386 - DNA, 16 bp, Artificial Sequence
  synthetic [barcode part1]
acacggaactcgacag

SEQ ID NO: 39387 - DNA, 16 bp, Artificial Sequence
  synthetic [barcode part1]
atagagttcgcaagtg

SEQ ID NO: 39388 - DNA, 16 bp, Artificial Sequence
  synthetic [barcode part1]
tcaccgcgataagact

SEQ ID NO: 39389 - DNA, 16 bp, Artificial Sequence
  synthetic [barcode part1]
tccaagtgaattggag

SEQ ID NO: 39390 - DNA, 16 bp, Artificial Sequence
  synthetic [barcode part1]
actctccaattcctcg

SEQ ID NO: 39391 - DNA, 16 bp, Artificial Sequence
  synthetic [barcode part1]
acactccagaagtgtc

SEQ ID NO: 39392 - DNA, 16 bp, Artificial Sequence
  synthetic [barcode part1]
tagtcctaccgtgcgt

SEQ ID NO: 39393 - DNA, 16 bp, Artificial Sequence
  synthetic [barcode part1]
gtcgttaccgaactag

SEQ ID NO: 39394 - DNA, 16 bp, Artificial Sequence
  synthetic [barcode part1]
atacagacagactacg

SEQ ID NO: 39395 - DNA, 16 bp, Artificial Sequence
  synthetic [barcode part1]
cctgtctgtaatactg

SEQ ID NO: 39396 - DNA, 16 bp, Artificial Sequence
  synthetic [barcode part1]
tagaacaacggccgtg

SEQ ID NO: 39397 - DNA, 16 bp, Artificial Sequence
  synthetic [barcode part1]
tgcagagatcagaccg

SEQ ID NO: 39398 - DNA, 16 bp, Artificial Sequence
  synthetic [barcode part1]
gagaaccactgtatag

SEQ ID NO: 39399 - DNA, 16 bp, Artificial Sequence
  synthetic [barcode part1]
tattgtccgccaatac

SEQ ID NO: 39400 - DNA, 16 bp, Artificial Sequence
  synthetic [barcode part1]
gatctgtatccacgag

SEQ ID NO: 39401 - DNA, 16 bp, Artificial Sequence
  synthetic [barcode part1]
tgcaacaggcaggtac

SEQ ID NO: 39402 - DNA, 16 bp, Artificial Sequence
  synthetic [barcode part1]
ttggacgtgaacgtct

SEQ ID NO: 39403 - DNA, 16 bp, Artificial Sequence
  synthetic [barcode part1]
tcgtaggccactgtct

SEQ ID NO: 39404 - DNA, 16 bp, Artificial Sequence
  synthetic [barcode part1]
agacagacaccgcagt

SEQ ID NO: 39405 - DNA, 16 bp, Artificial Sequence
  synthetic [barcode part1]
acgatctcgaatcacg

SEQ ID NO: 39406 - DNA, 16 bp, Artificial Sequence
  synthetic [barcode part1]
agacgtctgttgttct

SEQ ID NO: 39407 - DNA, 16 bp, Artificial Sequence
  synthetic [barcode part1]
aagataggacgcctgc

SEQ ID NO: 39408 - DNA, 16 bp, Artificial Sequence
  synthetic [barcode part1]
tgcgtgagacaatagt

SEQ ID NO: 39409 - DNA, 16 bp, Artificial Sequence
  synthetic [barcode part1]
gccacgttgacttctg

SEQ ID NO: 39410 - DNA, 16 bp, Artificial Sequence
  synthetic [barcode part1]
tctcacgtagtctggc

SEQ ID NO: 39411 - DNA, 16 bp, Artificial Sequence
  synthetic [barcode part1]
aacacgtactgacgtc

SEQ ID NO: 39412 - DNA, 16 bp, Artificial Sequence
  synthetic [barcode part1]
gtgagaggtcggattc

SEQ ID NO: 39413 - DNA, 16 bp, Artificial Sequence
  synthetic [barcode part1]
ttctactgaacttgcg

SEQ ID NO: 39414 - DNA, 16 bp, Artificial Sequence
  synthetic [barcode part1]
gactactcctgtattg

SEQ ID NO: 39415 - DNA, 16 bp, Artificial Sequence
  synthetic [barcode part1]
tcgaatcggaatacag

SEQ ID NO: 39416 - DNA, 16 bp, Artificial Sequence
  synthetic [barcode part1]
tgatacgccaatacgc

SEQ ID NO: 39417 - DNA, 16 bp, Artificial Sequence
  synthetic [barcode part1]
cgttgatattgacgcg

SEQ ID NO: 39418 - DNA, 16 bp, Artificial Sequence
  synthetic [barcode part1]
tcttccgaggtgtctg

SEQ ID NO: 39419 - DNA, 16 bp, Artificial Sequence
  synthetic [barcode part1]
agttgtcctgtcagag

SEQ ID NO: 39420 - DNA, 16 bp, Artificial Sequence
  synthetic [barcode part1]
acacacgtaacgtcgt

SEQ ID NO: 39421 - DNA, 16 bp, Artificial Sequence
  synthetic [barcode part1]
tctcagacagaactcg

SEQ ID NO: 39422 - DNA, 16 bp, Artificial Sequence
  synthetic [barcode part1]
tctaggactaaccgac

SEQ ID NO: 39423 - DNA, 16 bp, Artificial Sequence
  synthetic [barcode part1]
gttgacacgtcaacac

SEQ ID NO: 39424 - DNA, 16 bp, Artificial Sequence
  synthetic [barcode part1]
ccgttcgtgtcgtagt

SEQ ID NO: 39425 - DNA, 16 bp, Artificial Sequence
  synthetic [barcode part1]
cagtctcgtgcgttac

SEQ ID NO: 39426 - DNA, 16 bp, Artificial Sequence
  synthetic [barcode part1]
agactgtgttcttgtc

SEQ ID NO: 39427 - DNA, 16 bp, Artificial Sequence
  synthetic [barcode part1]
tagaggattccgacct

SEQ ID NO: 39428 - DNA, 16 bp, Artificial Sequence
  synthetic [barcode part1]
ataactgcgcggttgt

SEQ ID NO: 39429 - DNA, 16 bp, Artificial Sequence
  synthetic [barcode part1]
agtcctcctagtgcac

SEQ ID NO: 39430 - DNA, 16 bp, Artificial Sequence
  synthetic [barcode part1]
gagacgaccacagatc

SEQ ID NO: 39431 - DNA, 16 bp, Artificial Sequence
  synthetic [barcode part1]
tctgacagtcctcacg

SEQ ID NO: 39432 - DNA, 16 bp, Artificial Sequence
  synthetic [barcode part1]
taacggcctagatcgt

SEQ ID NO: 39433 - DNA, 16 bp, Artificial Sequence
  synthetic [barcode part1]
aggtatacaacgatcg

SEQ ID NO: 39434 - DNA, 16 bp, Artificial Sequence
  synthetic [barcode part1]
tctgaggcgtagtgtt

SEQ ID NO: 39435 - DNA, 16 bp, Artificial Sequence
  synthetic [barcode part1]
ttgcgtattctgactg

SEQ ID NO: 39436 - DNA, 16 bp, Artificial Sequence
  synthetic [barcode part1]
tcgtccaacggataac

SEQ ID NO: 39437 - DNA, 16 bp, Artificial Sequence
  synthetic [barcode part1]
tcagtagacgagaatc

SEQ ID NO: 39438 - DNA, 16 bp, Artificial Sequence
  synthetic [barcode part1]
aaggcagactcgcaac

SEQ ID NO: 39439 - DNA, 16 bp, Artificial Sequence
  synthetic [barcode part1]
gtgacagtactggcag

SEQ ID NO: 39440 - DNA, 16 bp, Artificial Sequence
  synthetic [barcode part1]
cgtcagacttatacct

SEQ ID NO: 39441 - DNA, 16 bp, Artificial Sequence
  synthetic [barcode part1]
tctcacctaggtattg

SEQ ID NO: 39442 - DNA, 16 bp, Artificial Sequence
  synthetic [barcode part1]
cctctaggttgacacc

SEQ ID NO: 39443 - DNA, 16 bp, Artificial Sequence
  synthetic [barcode part1]
gtgacgaaggtactcg

SEQ ID NO: 39444 - DNA, 16 bp, Artificial Sequence
  synthetic [barcode part1]
caatcctggaactggt

SEQ ID NO: 39445 - DNA, 16 bp, Artificial Sequence
  synthetic [barcode part1]
gtgtctacctggatag

SEQ ID NO: 39446 - DNA, 16 bp, Artificial Sequence
  synthetic [barcode part1]
gaacttgcactaacgc

SEQ ID NO: 39447 - DNA, 16 bp, Artificial Sequence
  synthetic [barcode part1]
ccactactgtccagac

SEQ ID NO: 39448 - DNA, 16 bp, Artificial Sequence
  synthetic [barcode part1]
agaaggagagaaggag

SEQ ID NO: 39449 - DNA, 16 bp, Artificial Sequence
  synthetic [barcode part1]
agatcacactcagtgc

SEQ ID NO: 39450 - DNA, 16 bp, Artificial Sequence
  synthetic [barcode part1]
atctcaccactaacgt

SEQ ID NO: 39451 - DNA, 16 bp, Artificial Sequence
  synthetic [barcode part1]
atcagtgtatcgacgc

SEQ ID NO: 39452 - DNA, 16 bp, Artificial Sequence
  synthetic [barcode part1]
aaccttcaggacggtt

SEQ ID NO: 39453 - DNA, 16 bp, Artificial Sequence
  synthetic [barcode part1]
gattcgatcttgtgtc

SEQ ID NO: 39454 - DNA, 16 bp, Artificial Sequence
  synthetic [barcode part1]
taaccaacggccaact

SEQ ID NO: 39455 - DNA, 16 bp, Artificial Sequence
  synthetic [barcode part1]
acgccagttgaatacc

SEQ ID NO: 39456 - DNA, 16 bp, Artificial Sequence
  synthetic [barcode part1]
taggtcacgatctgac

SEQ ID NO: 39457 - DNA, 16 bp, Artificial Sequence
  synthetic [barcode part1]
ttcgagtgtgatcacg

SEQ ID NO: 39458 - DNA, 16 bp, Artificial Sequence
  synthetic [barcode part1]
cctggttcgattacgc

SEQ ID NO: 39459 - DNA, 16 bp, Artificial Sequence
  synthetic [barcode part1]
tctgcggtctactgtg

SEQ ID NO: 39460 - DNA, 16 bp, Artificial Sequence
  synthetic [barcode part1]
tcacaggtctggtcct

SEQ ID NO: 39461 - DNA, 16 bp, Artificial Sequence
  synthetic [barcode part1]
caaggactctgtgttg

SEQ ID NO: 39462 - DNA, 16 bp, Artificial Sequence
  synthetic [barcode part1]
cctgttggtgtggttc

SEQ ID NO: 39463 - DNA, 16 bp, Artificial Sequence
  synthetic [barcode part1]
gaatcgcgccttcgtt

SEQ ID NO: 39464 - DNA, 16 bp, Artificial Sequence
  synthetic [barcode part1]
aagacgaggattcgtt

SEQ ID NO: 39465 - DNA, 16 bp, Artificial Sequence
  synthetic [barcode part1]
cgcctagtacgttaag

SEQ ID NO: 39466 - DNA, 16 bp, Artificial Sequence
  synthetic [barcode part1]
ttctaaccacgaatcc

SEQ ID NO: 39467 - DNA, 16 bp, Artificial Sequence
  synthetic [barcode part1]
caggattgagaaggac

SEQ ID NO: 39468 - DNA, 16 bp, Artificial Sequence
  synthetic [barcode part1]
cactacaccagaactg

SEQ ID NO: 39469 - DNA, 16 bp, Artificial Sequence
  synthetic [barcode part1]
tccagtaatagaggtg

SEQ ID NO: 39470 - DNA, 16 bp, Artificial Sequence
  synthetic [barcode part1]
gtatacacacgcgtgt

SEQ ID NO: 39471 - DNA, 16 bp, Artificial Sequence
  synthetic [barcode part1]
aataatcgcgttcctc

SEQ ID NO: 39472 - DNA, 16 bp, Artificial Sequence
  synthetic [barcode part1]
acagaagactagacct

SEQ ID NO: 39473 - DNA, 16 bp, Artificial Sequence
  synthetic [barcode part1]
cgactgagactgatct

SEQ ID NO: 39474 - DNA, 16 bp, Artificial Sequence
  synthetic [barcode part1]
gatcggattgcgcaag

SEQ ID NO: 39475 - DNA, 16 bp, Artificial Sequence
  synthetic [barcode part1]
gagaataatctgacgc

SEQ ID NO: 39476 - DNA, 16 bp, Artificial Sequence
  synthetic [barcode part1]
agaaggactaaggtcg

SEQ ID NO: 39477 - DNA, 16 bp, Artificial Sequence
  synthetic [barcode part1]
ttgagatcactcgtct

SEQ ID NO: 39478 - DNA, 16 bp, Artificial Sequence
  synthetic [barcode part1]
tcacttacaccgcgac

SEQ ID NO: 39479 - DNA, 16 bp, Artificial Sequence
  synthetic [barcode part1]
actctatacagttgcc

SEQ ID NO: 39480 - DNA, 16 bp, Artificial Sequence
  synthetic [barcode part1]
cggttccgcactagtt

SEQ ID NO: 39481 - DNA, 16 bp, Artificial Sequence
  synthetic [barcode part1]
cagagttgtcgatcac

SEQ ID NO: 39482 - DNA, 16 bp, Artificial Sequence
  synthetic [barcode part1]
acggtgcagttaatcc

SEQ ID NO: 39483 - DNA, 16 bp, Artificial Sequence
  synthetic [barcode part1]
atacaacggagtcagt

SEQ ID NO: 39484 - DNA, 16 bp, Artificial Sequence
  synthetic [barcode part1]
gactgactcttgaggt

SEQ ID NO: 39485 - DNA, 16 bp, Artificial Sequence
  synthetic [barcode part1]
gtctcaccttgtggac

SEQ ID NO: 39486 - DNA, 16 bp, Artificial Sequence
  synthetic [barcode part1]
cgttgtacttcggaag

SEQ ID NO: 39487 - DNA, 16 bp, Artificial Sequence
  synthetic [barcode part1]
gtgtggaacttagtag

SEQ ID NO: 39488 - DNA, 16 bp, Artificial Sequence
  synthetic [barcode part1]
attggaagttagtgcg

SEQ ID NO: 39489 - DNA, 16 bp, Artificial Sequence
  synthetic [barcode part1]
gttaacggcaagatac

SEQ ID NO: 39490 - DNA, 16 bp, Artificial Sequence
  synthetic [barcode part1]
gcgagtcactgagaac

SEQ ID NO: 39491 - DNA, 16 bp, Artificial Sequence
  synthetic [barcode part1]
acgactgcctcgatct

SEQ ID NO: 39492 - DNA, 16 bp, Artificial Sequence
  synthetic [barcode part1]
ataacgccgcaatacc

SEQ ID NO: 39493 - DNA, 16 bp, Artificial Sequence
  synthetic [barcode part1]
tacctacgcgatactt

SEQ ID NO: 39494 - DNA, 16 bp, Artificial Sequence
  synthetic [barcode part1]
gttcaggaacaaggtt

SEQ ID NO: 39495 - DNA, 16 bp, Artificial Sequence
  synthetic [barcode part1]
aagaacagtggaggtc

SEQ ID NO: 39496 - DNA, 16 bp, Artificial Sequence
  synthetic [barcode part1]
gaacttggtaaggtac

SEQ ID NO: 39497 - DNA, 16 bp, Artificial Sequence
  synthetic [barcode part1]
acagaaggttaccagt

SEQ ID NO: 39498 - DNA, 16 bp, Artificial Sequence
  synthetic [barcode part1]
ataattgtccttcggc

SEQ ID NO: 39499 - DNA, 16 bp, Artificial Sequence
  synthetic [barcode part1]
atcttctgtcacgtag

SEQ ID NO: 39500 - DNA, 16 bp, Artificial Sequence
  synthetic [barcode part1]
cctgtataatccggtt

SEQ ID NO: 39501 - DNA, 16 bp, Artificial Sequence
  synthetic [barcode part1]
caggtgtgaggtggtt

SEQ ID NO: 39502 - DNA, 16 bp, Artificial Sequence
  synthetic [barcode part1]
cagaatccacgtgtac

SEQ ID NO: 39503 - DNA, 16 bp, Artificial Sequence
  synthetic [barcode part1]
gagatccgataagtgt

SEQ ID NO: 39504 - DNA, 16 bp, Artificial Sequence
  synthetic [barcode part1]
tcggaatctgtccacc

SEQ ID NO: 39505 - DNA, 16 bp, Artificial Sequence
  synthetic [barcode part1]
tcagtactcttccaag

SEQ ID NO: 39506 - DNA, 16 bp, Artificial Sequence
  synthetic [barcode part1]
cacaacaaccttggac

SEQ ID NO: 39507 - DNA, 16 bp, Artificial Sequence
  synthetic [barcode part1]
cgtgttctagattacc

SEQ ID NO: 39508 - DNA, 16 bp, Artificial Sequence
  synthetic [barcode part1]
gcaatcaacgcactac

SEQ ID NO: 39509 - DNA, 16 bp, Artificial Sequence
  synthetic [barcode part1]
cacaggaggtctaacg

SEQ ID NO: 39510 - DNA, 16 bp, Artificial Sequence
  synthetic [barcode part1]
gcgtaagacctggtag

SEQ ID NO: 39511 - DNA, 16 bp, Artificial Sequence
  synthetic [barcode part1]
cacagatcctattacc

SEQ ID NO: 39512 - DNA, 16 bp, Artificial Sequence
  synthetic [barcode part1]
gcgactggaggttaac

SEQ ID NO: 39513 - DNA, 16 bp, Artificial Sequence
  synthetic [barcode part1]
taacctgaggtgcgag

SEQ ID NO: 39514 - DNA, 16 bp, Artificial Sequence
  synthetic [barcode part1]
tcttaactcggtgtac

SEQ ID NO: 39515 - DNA, 16 bp, Artificial Sequence
  synthetic [barcode part1]
gtctactacaggcagt

SEQ ID NO: 39516 - DNA, 16 bp, Artificial Sequence
  synthetic [barcode part1]
ttattagacgcctctg

SEQ ID NO: 39517 - DNA, 16 bp, Artificial Sequence
  synthetic [barcode part1]
tccagaaggttgatcc

SEQ ID NO: 39518 - DNA, 16 bp, Artificial Sequence
  synthetic [barcode part1]
tgttacctaccggcgt

SEQ ID NO: 39519 - DNA, 16 bp, Artificial Sequence
  synthetic [barcode part1]
tggagacgtagaagtg

SEQ ID NO: 39520 - DNA, 16 bp, Artificial Sequence
  synthetic [barcode part1]
gcaagactgttactcg

SEQ ID NO: 39521 - DNA, 16 bp, Artificial Sequence
  synthetic [barcode part1]
ccgagattgtcgtagt

SEQ ID NO: 39522 - DNA, 16 bp, Artificial Sequence
  synthetic [barcode part1]
gtgtaggcctgtattg

SEQ ID NO: 39523 - DNA, 16 bp, Artificial Sequence
  synthetic [barcode part1]
tgttgagtggagatac

SEQ ID NO: 39524 - DNA, 16 bp, Artificial Sequence
  synthetic [barcode part1]
aacgtctctgttgccg

SEQ ID NO: 39525 - DNA, 16 bp, Artificial Sequence
  synthetic [barcode part1]
agatagacgttgtgac

SEQ ID NO: 39526 - DNA, 16 bp, Artificial Sequence
  synthetic [barcode part1]
tgactgaacgtcgtac

SEQ ID NO: 39527 - DNA, 16 bp, Artificial Sequence
  synthetic [barcode part1]
atcagtctcagaaccg

SEQ ID NO: 39528 - DNA, 16 bp, Artificial Sequence
  synthetic [barcode part1]
gtgcgtctctaacctg

SEQ ID NO: 39529 - DNA, 16 bp, Artificial Sequence
  synthetic [barcode part1]
tatcggacactggatc

SEQ ID NO: 39530 - DNA, 16 bp, Artificial Sequence
  synthetic [barcode part1]
ttcctgaggagttggt

SEQ ID NO: 39531 - DNA, 16 bp, Artificial Sequence
  synthetic [barcode part1]
gtcacaggccttaagt

SEQ ID NO: 39532 - DNA, 16 bp, Artificial Sequence
  synthetic [barcode part1]
ttggtacactggtacg

SEQ ID NO: 39533 - DNA, 16 bp, Artificial Sequence
  synthetic [barcode part1]
tgaacggaagtgagtg

SEQ ID NO: 39534 - DNA, 16 bp, Artificial Sequence
  synthetic [barcode part1]
actctaggttggtcag

SEQ ID NO: 39535 - DNA, 16 bp, Artificial Sequence
  synthetic [barcode part1]
acgtggagtagaagtg

SEQ ID NO: 39536 - DNA, 16 bp, Artificial Sequence
  synthetic [barcode part1]
caatcaggtcagttgc

SEQ ID NO: 39537 - DNA, 16 bp, Artificial Sequence
  synthetic [barcode part1]
tgactcactgtattcg

SEQ ID NO: 39538 - DNA, 16 bp, Artificial Sequence
  synthetic [barcode part1]
cctcgcagtcgaatct

SEQ ID NO: 39539 - DNA, 16 bp, Artificial Sequence
  synthetic [barcode part1]
acctagataagacgac

SEQ ID NO: 39540 - DNA, 16 bp, Artificial Sequence
  synthetic [barcode part1]
aattctcaccggagac

SEQ ID NO: 39541 - DNA, 16 bp, Artificial Sequence
  synthetic [barcode part1]
actccactaggttcgc

SEQ ID NO: 39542 - DNA, 16 bp, Artificial Sequence
  synthetic [barcode part1]
tgtctgttctgaggtt

SEQ ID NO: 39543 - DNA, 16 bp, Artificial Sequence
  synthetic [barcode part1]
gcacaactgacacact

SEQ ID NO: 39544 - DNA, 16 bp, Artificial Sequence
  synthetic [barcode part1]
tagacactgtggatcc

SEQ ID NO: 39545 - DNA, 16 bp, Artificial Sequence
  synthetic [barcode part1]
caatcagtcaggatcc

SEQ ID NO: 39546 - DNA, 16 bp, Artificial Sequence
  synthetic [barcode part1]
cggtagtagaggcact

SEQ ID NO: 39547 - DNA, 16 bp, Artificial Sequence
  synthetic [barcode part1]
tgtcttacaaggcgac

SEQ ID NO: 39548 - DNA, 16 bp, Artificial Sequence
  synthetic [barcode part1]
tcgtgtctccaataac

SEQ ID NO: 39549 - DNA, 16 bp, Artificial Sequence
  synthetic [barcode part1]
ttacaccggcggttct

SEQ ID NO: 39550 - DNA, 16 bp, Artificial Sequence
  synthetic [barcode part1]
gcaaggaatactcctc

SEQ ID NO: 39551 - DNA, 16 bp, Artificial Sequence
  synthetic [barcode part1]
gtggaggattagactt

SEQ ID NO: 39552 - DNA, 16 bp, Artificial Sequence
  synthetic [barcode part1]
tctgtccgagtctcag

SEQ ID NO: 39553 - DNA, 16 bp, Artificial Sequence
  synthetic [barcode part1]
acacgaggtaagaacg

SEQ ID NO: 39554 - DNA, 16 bp, Artificial Sequence
  synthetic [barcode part1]
cctggtgttatcgaag

SEQ ID NO: 39555 - DNA, 16 bp, Artificial Sequence
  synthetic [barcode part1]
aggaccagtacggttg

SEQ ID NO: 39556 - DNA, 16 bp, Artificial Sequence
  synthetic [barcode part1]
ttataaccacgcgcag

SEQ ID NO: 39557 - DNA, 16 bp, Artificial Sequence
  synthetic [barcode part1]
cgttggaacgaagatt

SEQ ID NO: 39558 - DNA, 16 bp, Artificial Sequence
  synthetic [barcode part1]
gttgttggacttgacg

SEQ ID NO: 39559 - DNA, 16 bp, Artificial Sequence
  synthetic [barcode part1]
tgtcacctacttcacc

SEQ ID NO: 39560 - DNA, 16 bp, Artificial Sequence
  synthetic [barcode part1]
gatatcgtggttggtc

SEQ ID NO: 39561 - DNA, 16 bp, Artificial Sequence
  synthetic [barcode part1]
tagttgccggaaggtg

SEQ ID NO: 39562 - DNA, 16 bp, Artificial Sequence
  synthetic [barcode part1]
ttctcgagtactgact

SEQ ID NO: 39563 - DNA, 16 bp, Artificial Sequence
  synthetic [barcode part1]
agactctgaccaatcg

SEQ ID NO: 39564 - DNA, 16 bp, Artificial Sequence
  synthetic [barcode part1]
tctgaggtacggtgtt

SEQ ID NO: 39565 - DNA, 16 bp, Artificial Sequence
  synthetic [barcode part1]
caatccacgttaggtg

SEQ ID NO: 39566 - DNA, 16 bp, Artificial Sequence
  synthetic [barcode part1]
gcaggtaatcttgaag

SEQ ID NO: 39567 - DNA, 16 bp, Artificial Sequence
  synthetic [barcode part1]
tagtgcgccagatact

SEQ ID NO: 39568 - DNA, 16 bp, Artificial Sequence
  synthetic [barcode part1]
cagattcgtccacaag

SEQ ID NO: 39569 - DNA, 16 bp, Artificial Sequence
  synthetic [barcode part1]
tacacactgcagtacg

SEQ ID NO: 39570 - DNA, 16 bp, Artificial Sequence
  synthetic [barcode part1]
actctcggacagttcc

SEQ ID NO: 39571 - DNA, 16 bp, Artificial Sequence
  synthetic [barcode part1]
cctgccagagatagtt

SEQ ID NO: 39572 - DNA, 16 bp, Artificial Sequence
  synthetic [barcode part1]
gtggtcacacacaact

SEQ ID NO: 39573 - DNA, 16 bp, Artificial Sequence
  synthetic [barcode part1]
tgatcttcgtacagtc

SEQ ID NO: 39574 - DNA, 16 bp, Artificial Sequence
  synthetic [barcode part1]
acggttgccggttctt

SEQ ID NO: 39575 - DNA, 16 bp, Artificial Sequence
  synthetic [barcode part1]
gataaggtgcggacct

SEQ ID NO: 39576 - DNA, 16 bp, Artificial Sequence
  synthetic [barcode part1]
atcaacgttcacaggc

SEQ ID NO: 39577 - DNA, 16 bp, Artificial Sequence
  synthetic [barcode part1]
agtgccaatacgcgtt

SEQ ID NO: 39578 - DNA, 16 bp, Artificial Sequence
  synthetic [barcode part1]
attggaactctgaccg

SEQ ID NO: 39579 - DNA, 16 bp, Artificial Sequence
  synthetic [barcode part1]
agtagtcctagtggtc

SEQ ID NO: 39580 - DNA, 16 bp, Artificial Sequence
  synthetic [barcode part1]
cgaatacttcctggcc

SEQ ID NO: 39581 - DNA, 16 bp, Artificial Sequence
  synthetic [barcode part1]
gtaggttaaccgtacc

SEQ ID NO: 39582 - DNA, 16 bp, Artificial Sequence
  synthetic [barcode part1]
gacagtcagaacgcgt

SEQ ID NO: 39583 - DNA, 16 bp, Artificial Sequence
  synthetic [barcode part1]
aggtcgtgtaatccgt

SEQ ID NO: 39584 - DNA, 16 bp, Artificial Sequence
  synthetic [barcode part1]
agattccaccgtaacg

SEQ ID NO: 39585 - DNA, 16 bp, Artificial Sequence
  synthetic [barcode part1]
tctacgaaggtaacag

SEQ ID NO: 39586 - DNA, 16 bp, Artificial Sequence
  synthetic [barcode part1]
aattccgccacaacag

SEQ ID NO: 39587 - DNA, 16 bp, Artificial Sequence
  synthetic [barcode part1]
ccttccaatccagacg

SEQ ID NO: 39588 - DNA, 16 bp, Artificial Sequence
  synthetic [barcode part1]
tacctacagattccgt

SEQ ID NO: 39589 - DNA, 16 bp, Artificial Sequence
  synthetic [barcode part1]
gccttaaggttgatcg

SEQ ID NO: 39590 - DNA, 16 bp, Artificial Sequence
  synthetic [barcode part1]
acgacagagtgtattg

SEQ ID NO: 39591 - DNA, 16 bp, Artificial Sequence
  synthetic [barcode part1]
tcaaggtcaagactcc

SEQ ID NO: 39592 - DNA, 16 bp, Artificial Sequence
  synthetic [barcode part1]
tgagatctacgtacgc

SEQ ID NO: 39593 - DNA, 16 bp, Artificial Sequence
  synthetic [barcode part1]
ttaggcacgccacttc

SEQ ID NO: 39594 - DNA, 16 bp, Artificial Sequence
  synthetic [barcode part1]
ccgtctagaacctcac

SEQ ID NO: 39595 - DNA, 16 bp, Artificial Sequence
  synthetic [barcode part1]
taggtggcaggacttg

SEQ ID NO: 39596 - DNA, 16 bp, Artificial Sequence
  synthetic [barcode part1]
aacctggcgtggaagt

SEQ ID NO: 39597 - DNA, 16 bp, Artificial Sequence
  synthetic [barcode part1]
gtactggaatcgcgtt

SEQ ID NO: 39598 - DNA, 16 bp, Artificial Sequence
  synthetic [barcode part1]
cgtgcgtgttaactag

SEQ ID NO: 39599 - DNA, 16 bp, Artificial Sequence
  synthetic [barcode part1]
aggtattcactgtcct

SEQ ID NO: 39600 - DNA, 16 bp, Artificial Sequence
  synthetic [barcode part1]
atacctccgataacct

SEQ ID NO: 39601 - DNA, 16 bp, Artificial Sequence
  synthetic [barcode part1]
gtggttggactggagt

SEQ ID NO: 39602 - DNA, 16 bp, Artificial Sequence
  synthetic [barcode part1]
gacgtgattgtacctg

SEQ ID NO: 39603 - DNA, 16 bp, Artificial Sequence
  synthetic [barcode part1]
tccgcacttaggtcgt

SEQ ID NO: 39604 - DNA, 16 bp, Artificial Sequence
  synthetic [barcode part1]
ttcctggatacgttac

SEQ ID NO: 39605 - DNA, 16 bp, Artificial Sequence
  synthetic [barcode part1]
cctaagagttgactgc

SEQ ID NO: 39606 - DNA, 16 bp, Artificial Sequence
  synthetic [barcode part1]
gtcgatactgttactc

SEQ ID NO: 39607 - DNA, 16 bp, Artificial Sequence
  synthetic [barcode part1]
agatattcgagacgac

SEQ ID NO: 39608 - DNA, 16 bp, Artificial Sequence
  synthetic [barcode part1]
aacaggacggtcttct

SEQ ID NO: 39609 - DNA, 16 bp, Artificial Sequence
  synthetic [barcode part1]
gtgttggttaacgcgt

SEQ ID NO: 39610 - DNA, 16 bp, Artificial Sequence
  synthetic [barcode part1]
tctcacacggcagtct

SEQ ID NO: 39611 - DNA, 16 bp, Artificial Sequence
  synthetic [barcode part1]
gaaggatacaggacgt

SEQ ID NO: 39612 - DNA, 16 bp, Artificial Sequence
  synthetic [barcode part1]
ttggtccacgattatc

SEQ ID NO: 39613 - DNA, 16 bp, Artificial Sequence
  synthetic [barcode part1]
tcctcgttctgtatcg

SEQ ID NO: 39614 - DNA, 16 bp, Artificial Sequence
  synthetic [barcode part1]
caatcagtgaccaacc

SEQ ID NO: 39615 - DNA, 16 bp, Artificial Sequence
  synthetic [barcode part1]
tagagtctgtgtgtgc

SEQ ID NO: 39616 - DNA, 16 bp, Artificial Sequence
  synthetic [barcode part1]
taactccgttgacgtt

SEQ ID NO: 39617 - DNA, 16 bp, Artificial Sequence
  synthetic [barcode part1]
gcgatatcagtcagtc

SEQ ID NO: 39618 - DNA, 16 bp, Artificial Sequence
  synthetic [barcode part1]
gcaggattggatattg

SEQ ID NO: 39619 - DNA, 16 bp, Artificial Sequence
  synthetic [barcode part1]
gttcgcctaccacagt

SEQ ID NO: 39620 - DNA, 16 bp, Artificial Sequence
  synthetic [barcode part1]
tatccgagttactctg

SEQ ID NO: 39621 - DNA, 16 bp, Artificial Sequence
  synthetic [barcode part1]
gcggttcaagtgcaag

SEQ ID NO: 39622 - DNA, 16 bp, Artificial Sequence
  synthetic [barcode part1]
aatctgaagaacgcgt

SEQ ID NO: 39623 - DNA, 16 bp, Artificial Sequence
  synthetic [barcode part1]
tgaacacagaagttgc

SEQ ID NO: 39624 - DNA, 16 bp, Artificial Sequence
  synthetic [barcode part1]
ttctggtcctccgatt

SEQ ID NO: 39625 - DNA, 16 bp, Artificial Sequence
  synthetic [barcode part1]
ccttcgagtcacacac

SEQ ID NO: 39626 - DNA, 16 bp, Artificial Sequence
  synthetic [barcode part1]
aaggatagtggtctac

SEQ ID NO: 39627 - DNA, 16 bp, Artificial Sequence
  synthetic [barcode part1]
ccttggtatcgagaac

SEQ ID NO: 39628 - DNA, 16 bp, Artificial Sequence
  synthetic [barcode part1]
tcgagaccgaagtctt

SEQ ID NO: 39629 - DNA, 16 bp, Artificial Sequence
  synthetic [barcode part1]
actcacttgtccgtct

SEQ ID NO: 39630 - DNA, 16 bp, Artificial Sequence
  synthetic [barcode part1]
gcgattgtgcgtagtt

SEQ ID NO: 39631 - DNA, 16 bp, Artificial Sequence
  synthetic [barcode part1]
tcagacgtcacctcgt

SEQ ID NO: 39632 - DNA, 16 bp, Artificial Sequence
  synthetic [barcode part1]
aattgtactggaggac

SEQ ID NO: 39633 - DNA, 16 bp, Artificial Sequence
  synthetic [barcode part1]
gttggattggaggtgc

SEQ ID NO: 39634 - DNA, 16 bp, Artificial Sequence
  synthetic [barcode part1]
atctgtcgcaggtagt

SEQ ID NO: 39635 - DNA, 16 bp, Artificial Sequence
  synthetic [barcode part1]
cggcaacgttgaattc

SEQ ID NO: 39636 - DNA, 16 bp, Artificial Sequence
  synthetic [barcode part1]
ccaaggcctacaatac

SEQ ID NO: 39637 - DNA, 16 bp, Artificial Sequence
  synthetic [barcode part1]
gccttctgacttcttg

SEQ ID NO: 39638 - DNA, 16 bp, Artificial Sequence
  synthetic [barcode part1]
agtatcgttctcctcc

SEQ ID NO: 39639 - DNA, 16 bp, Artificial Sequence
  synthetic [barcode part1]
acgaattcacaggcct

SEQ ID NO: 39640 - DNA, 16 bp, Artificial Sequence
  synthetic [barcode part1]
gtgacacagaaggagt

SEQ ID NO: 39641 - DNA, 16 bp, Artificial Sequence
  synthetic [barcode part1]
taggcactgatagagt

SEQ ID NO: 39642 - DNA, 16 bp, Artificial Sequence
  synthetic [barcode part1]
taggtgtcacagatcc

SEQ ID NO: 39643 - DNA, 16 bp, Artificial Sequence
  synthetic [barcode part1]
cggactgtatattctc

SEQ ID NO: 39644 - DNA, 16 bp, Artificial Sequence
  synthetic [barcode part1]
tgacgagacctgcaag

SEQ ID NO: 39645 - DNA, 16 bp, Artificial Sequence
  synthetic [barcode part1]
aactccttcaacacgt

SEQ ID NO: 39646 - DNA, 16 bp, Artificial Sequence
  synthetic [barcode part1]
tatcggattcgcgtcc

SEQ ID NO: 39647 - DNA, 16 bp, Artificial Sequence
  synthetic [barcode part1]
gtgaggaagttgtcgc

SEQ ID NO: 39648 - DNA, 16 bp, Artificial Sequence
  synthetic [barcode part1]
gtacttgacggcgaag

SEQ ID NO: 39649 - DNA, 16 bp, Artificial Sequence
  synthetic [barcode part1]
ataccttacgcaaggc

SEQ ID NO: 39650 - DNA, 16 bp, Artificial Sequence
  synthetic [barcode part1]
tagagttaccgcgact

SEQ ID NO: 39651 - DNA, 16 bp, Artificial Sequence
  synthetic [barcode part1]
gtgtgtgactgcaact

SEQ ID NO: 39652 - DNA, 16 bp, Artificial Sequence
  synthetic [barcode part1]
gactgttagtgacctg

SEQ ID NO: 39653 - DNA, 16 bp, Artificial Sequence
  synthetic [barcode part1]
aggaccagtgtctgag

SEQ ID NO: 39654 - DNA, 16 bp, Artificial Sequence
  synthetic [barcode part1]
cactgaagtaactcgc

SEQ ID NO: 39655 - DNA, 16 bp, Artificial Sequence
  synthetic [barcode part1]
tgtccaactgaacacg

SEQ ID NO: 39656 - DNA, 16 bp, Artificial Sequence
  synthetic [barcode part1]
ttgcggagatagtagt

SEQ ID NO: 39657 - DNA, 16 bp, Artificial Sequence
  synthetic [barcode part1]
actctgtaagtgtcct

SEQ ID NO: 39658 - DNA, 16 bp, Artificial Sequence
  synthetic [barcode part1]
gaggtaatcgtaggtt

SEQ ID NO: 39659 - DNA, 16 bp, Artificial Sequence
  synthetic [barcode part1]
taattgacgcacgtgc

SEQ ID NO: 39660 - DNA, 16 bp, Artificial Sequence
  synthetic [barcode part1]
cagaaggttgacttcc

SEQ ID NO: 39661 - DNA, 16 bp, Artificial Sequence
  synthetic [barcode part1]
tgatagattgcgaacg

SEQ ID NO: 39662 - DNA, 16 bp, Artificial Sequence
  synthetic [barcode part1]
aagtattacctcgtcc

SEQ ID NO: 39663 - DNA, 16 bp, Artificial Sequence
  synthetic [barcode part1]
gatctcctcttactgc

SEQ ID NO: 39664 - DNA, 16 bp, Artificial Sequence
  synthetic [barcode part1]
gacagttgattgtcgc

SEQ ID NO: 39665 - DNA, 16 bp, Artificial Sequence
  synthetic [barcode part1]
cgtagatcctattgtc

SEQ ID NO: 39666 - DNA, 16 bp, Artificial Sequence
  synthetic [barcode part1]
gataactgtcgccagt

SEQ ID NO: 39667 - DNA, 16 bp, Artificial Sequence
  synthetic [barcode part1]
agaataagtccgtggt

SEQ ID NO: 39668 - DNA, 16 bp, Artificial Sequence
  synthetic [barcode part1]
taagttggatcgccgt

SEQ ID NO: 39669 - DNA, 16 bp, Artificial Sequence
  synthetic [barcode part1]
tgaccttattgtgcgt

SEQ ID NO: 39670 - DNA, 16 bp, Artificial Sequence
  synthetic [barcode part1]
ccgcaagtatcagtac

SEQ ID NO: 39671 - DNA, 16 bp, Artificial Sequence
  synthetic [barcode part1]
gacctgcctatctcag

SEQ ID NO: 39672 - DNA, 16 bp, Artificial Sequence
  synthetic [barcode part1]
gaacctgcgaattcgt

SEQ ID NO: 39673 - DNA, 16 bp, Artificial Sequence
  synthetic [barcode part1]
acttgttacgacactc

SEQ ID NO: 39674 - DNA, 16 bp, Artificial Sequence
  synthetic [barcode part1]
acgtagttgcgatcac

SEQ ID NO: 39675 - DNA, 16 bp, Artificial Sequence
  synthetic [barcode part1]
ccgaacacactatctt

SEQ ID NO: 39676 - DNA, 16 bp, Artificial Sequence
  synthetic [barcode part1]
cgattctactggtgtt

SEQ ID NO: 39677 - DNA, 16 bp, Artificial Sequence
  synthetic [barcode part1]
agtgatacgagtgttg

SEQ ID NO: 39678 - DNA, 16 bp, Artificial Sequence
  synthetic [barcode part1]
agattcacctgcaggt

SEQ ID NO: 39679 - DNA, 16 bp, Artificial Sequence
  synthetic [barcode part1]
tggaactatacgtgcc

SEQ ID NO: 39680 - DNA, 16 bp, Artificial Sequence
  synthetic [barcode part1]
actacgagacaggtgc

SEQ ID NO: 39681 - DNA, 16 bp, Artificial Sequence
  synthetic [barcode part1]
tcgtgaactcacgaac

SEQ ID NO: 39682 - DNA, 16 bp, Artificial Sequence
  synthetic [barcode part1]
cagttcctgatcgtgc

SEQ ID NO: 39683 - DNA, 16 bp, Artificial Sequence
  synthetic [barcode part1]
ttactggtctcgcacg

SEQ ID NO: 39684 - DNA, 16 bp, Artificial Sequence
  synthetic [barcode part1]
tgagttgtgacgatcc

SEQ ID NO: 39685 - DNA, 16 bp, Artificial Sequence
  synthetic [barcode part1]
tgcgcaggtctcttac

SEQ ID NO: 39686 - DNA, 16 bp, Artificial Sequence
  synthetic [barcode part1]
ttggacagagtggtgc

SEQ ID NO: 39687 - DNA, 16 bp, Artificial Sequence
  synthetic [barcode part1]
aagacttggtaggtgt

SEQ ID NO: 39688 - DNA, 16 bp, Artificial Sequence
  synthetic [barcode part1]
agaagtacgccttcac

SEQ ID NO: 39689 - DNA, 16 bp, Artificial Sequence
  synthetic [barcode part1]
caggtagatctgtctg

SEQ ID NO: 39690 - DNA, 16 bp, Artificial Sequence
  synthetic [barcode part1]
gaagaccttgaggaag

SEQ ID NO: 39691 - DNA, 16 bp, Artificial Sequence
  synthetic [barcode part1]
aggtgttgcaatagac

SEQ ID NO: 39692 - DNA, 16 bp, Artificial Sequence
  synthetic [barcode part1]
ttccggtcgcaagttc

SEQ ID NO: 39693 - DNA, 16 bp, Artificial Sequence
  synthetic [barcode part1]
agtctaggactcaacc

SEQ ID NO: 39694 - DNA, 16 bp, Artificial Sequence
  synthetic [barcode part1]
gtcctaatctctcctg

SEQ ID NO: 39695 - DNA, 16 bp, Artificial Sequence
  synthetic [barcode part1]
attctgtctgtgcaac

SEQ ID NO: 39696 - DNA, 16 bp, Artificial Sequence
  synthetic [barcode part1]
tctcggttgatcttcc

SEQ ID NO: 39697 - DNA, 16 bp, Artificial Sequence
  synthetic [barcode part1]
ttaccgcactctgttc

SEQ ID NO: 39698 - DNA, 16 bp, Artificial Sequence
  synthetic [barcode part1]
gtcaccggattgttag

SEQ ID NO: 39699 - DNA, 16 bp, Artificial Sequence
  synthetic [barcode part1]
aacaacaggacttacg

SEQ ID NO: 39700 - DNA, 16 bp, Artificial Sequence
  synthetic [barcode part1]
tagtctggaatcaccg

SEQ ID NO: 39701 - DNA, 16 bp, Artificial Sequence
  synthetic [barcode part1]
caggaaggagattgac

SEQ ID NO: 39702 - DNA, 16 bp, Artificial Sequence
  synthetic [barcode part1]
accagtgtgaggaatt

SEQ ID NO: 39703 - DNA, 16 bp, Artificial Sequence
  synthetic [barcode part1]
atcagaatacgcagtg

SEQ ID NO: 39704 - DNA, 16 bp, Artificial Sequence
  synthetic [barcode part1]
gaccaactggtactgt

SEQ ID NO: 39705 - DNA, 16 bp, Artificial Sequence
  synthetic [barcode part1]
accgagtagtgacctt

SEQ ID NO: 39706 - DNA, 16 bp, Artificial Sequence
  synthetic [barcode part1]
gtcttacgcctagatt

SEQ ID NO: 39707 - DNA, 16 bp, Artificial Sequence
  synthetic [barcode part1]
aagtattctactccgc

SEQ ID NO: 39708 - DNA, 16 bp, Artificial Sequence
  synthetic [barcode part1]
tgcggcagatattgtc

SEQ ID NO: 39709 - DNA, 16 bp, Artificial Sequence
  synthetic [barcode part1]
agagtgcagagatacg

SEQ ID NO: 39710 - DNA, 16 bp, Artificial Sequence
  synthetic [barcode part1]
tataacgtccgttcgt

SEQ ID NO: 39711 - DNA, 16 bp, Artificial Sequence
  synthetic [barcode part1]
actggaggtaccaacg

SEQ ID NO: 39712 - DNA, 16 bp, Artificial Sequence
  synthetic [barcode part1]
gacaattgccgtcagt

SEQ ID NO: 39713 - DNA, 16 bp, Artificial Sequence
  synthetic [barcode part1]
tggtgacgaggtacgt

SEQ ID NO: 39714 - DNA, 16 bp, Artificial Sequence
  synthetic [barcode part1]
gagtgaagtctgtcct

SEQ ID NO: 39715 - DNA, 16 bp, Artificial Sequence
  synthetic [barcode part1]
acaattaggagtcgac

SEQ ID NO: 39716 - DNA, 16 bp, Artificial Sequence
  synthetic [barcode part1]
cctagagaccgtgatt

SEQ ID NO: 39717 - DNA, 16 bp, Artificial Sequence
  synthetic [barcode part1]
gtggagtaggtctacg

SEQ ID NO: 39718 - DNA, 16 bp, Artificial Sequence
  synthetic [barcode part1]
cgaaggatccttcaac

SEQ ID NO: 39719 - DNA, 16 bp, Artificial Sequence
  synthetic [barcode part1]
attaggccacttccgc

SEQ ID NO: 39720 - DNA, 16 bp, Artificial Sequence
  synthetic [barcode part1]
aggtcgaaccaacgtg

SEQ ID NO: 39721 - DNA, 16 bp, Artificial Sequence
  synthetic [barcode part1]
tccgatcactgcacac

SEQ ID NO: 39722 - DNA, 16 bp, Artificial Sequence
  synthetic [barcode part1]
gcgttccgtattctct

SEQ ID NO: 39723 - DNA, 16 bp, Artificial Sequence
  synthetic [barcode part1]
atactcttcctgcacc

SEQ ID NO: 39724 - DNA, 16 bp, Artificial Sequence
  synthetic [barcode part1]
gcgaagaccaataatc

SEQ ID NO: 39725 - DNA, 16 bp, Artificial Sequence
  synthetic [barcode part1]
cgtccgtcagagttct

SEQ ID NO: 39726 - DNA, 16 bp, Artificial Sequence
  synthetic [barcode part1]
gcagacttacgttggt

SEQ ID NO: 39727 - DNA, 16 bp, Artificial Sequence
  synthetic [barcode part1]
acgagagaatctgatc

SEQ ID NO: 39728 - DNA, 16 bp, Artificial Sequence
  synthetic [barcode part1]
gatacgtccaattctc

SEQ ID NO: 39729 - DNA, 16 bp, Artificial Sequence
  synthetic [barcode part1]
tagaagtctgtcgaag

SEQ ID NO: 39730 - DNA, 16 bp, Artificial Sequence
  synthetic [barcode part1]
aacttggaaccaccac

SEQ ID NO: 39731 - DNA, 16 bp, Artificial Sequence
  synthetic [barcode part1]
atagagtgtcctaccg

SEQ ID NO: 39732 - DNA, 16 bp, Artificial Sequence
  synthetic [barcode part1]
atagtgttgacgccgt

SEQ ID NO: 39733 - DNA, 16 bp, Artificial Sequence
  synthetic [barcode part1]
aaccaacctagttggc

SEQ ID NO: 39734 - DNA, 16 bp, Artificial Sequence
  synthetic [barcode part1]
tggtctaacttccgcg

SEQ ID NO: 39735 - DNA, 16 bp, Artificial Sequence
  synthetic [barcode part1]
gtctctgtctggtgac

SEQ ID NO: 39736 - DNA, 16 bp, Artificial Sequence
  synthetic [barcode part1]
cgccgaatctatattc

SEQ ID NO: 39737 - DNA, 16 bp, Artificial Sequence
  synthetic [barcode part1]
gatcgacaactctggt

SEQ ID NO: 39738 - DNA, 16 bp, Artificial Sequence
  synthetic [barcode part1]
gtgtccttgtactctc

SEQ ID NO: 39739 - DNA, 16 bp, Artificial Sequence
  synthetic [barcode part1]
gccactctcgtgagtt

SEQ ID NO: 39740 - DNA, 16 bp, Artificial Sequence
  synthetic [barcode part1]
taaggaacaatcgtgc

SEQ ID NO: 39741 - DNA, 16 bp, Artificial Sequence
  synthetic [barcode part1]
ccgttcactataacac

SEQ ID NO: 39742 - DNA, 16 bp, Artificial Sequence
  synthetic [barcode part1]
aacctacggcaaggtg

SEQ ID NO: 39743 - DNA, 16 bp, Artificial Sequence
  synthetic [barcode part1]
cacagatcgagtgttc

SEQ ID NO: 39744 - DNA, 16 bp, Artificial Sequence
  synthetic [barcode part1]
ccacctaacaatatcc

SEQ ID NO: 39745 - DNA, 16 bp, Artificial Sequence
  synthetic [barcode part1]
tagaagacacacggcc

SEQ ID NO: 39746 - DNA, 16 bp, Artificial Sequence
  synthetic [barcode part1]
ttcttacacagtccag

SEQ ID NO: 39747 - DNA, 16 bp, Artificial Sequence
  synthetic [barcode part1]
tccacacgttggatcc

SEQ ID NO: 39748 - DNA, 16 bp, Artificial Sequence
  synthetic [barcode part1]
cgtccacacttcaggt

SEQ ID NO: 39749 - DNA, 16 bp, Artificial Sequence
  synthetic [barcode part1]
actgacttgtgcgtag

SEQ ID NO: 39750 - DNA, 16 bp, Artificial Sequence
  synthetic [barcode part1]
acaacggcggattcag

SEQ ID NO: 39751 - DNA, 16 bp, Artificial Sequence
  synthetic [barcode part1]
gaaggcgagtgactct

SEQ ID NO: 39752 - DNA, 16 bp, Artificial Sequence
  synthetic [barcode part1]
gtctacttactacggt

SEQ ID NO: 39753 - DNA, 16 bp, Artificial Sequence
  synthetic [barcode part1]
ttcagtgagactaccg

SEQ ID NO: 39754 - DNA, 16 bp, Artificial Sequence
  synthetic [barcode part1]
gcgactgttaagaggc

SEQ ID NO: 39755 - DNA, 16 bp, Artificial Sequence
  synthetic [barcode part1]
cgcacctgatacaagt

SEQ ID NO: 39756 - DNA, 16 bp, Artificial Sequence
  synthetic [barcode part1]
gtcaggatagttacag

SEQ ID NO: 39757 - DNA, 16 bp, Artificial Sequence
  synthetic [barcode part1]
gttgtagtccgaagtc

SEQ ID NO: 39758 - DNA, 16 bp, Artificial Sequence
  synthetic [barcode part1]
taccagtccaatcttg

SEQ ID NO: 39759 - DNA, 16 bp, Artificial Sequence
  synthetic [barcode part1]
tactggaagtgcaggc

SEQ ID NO: 39760 - DNA, 16 bp, Artificial Sequence
  synthetic [barcode part1]
tctaatccgacacgcc

SEQ ID NO: 39761 - DNA, 16 bp, Artificial Sequence
  synthetic [barcode part1]
cgccttgataggtcct

SEQ ID NO: 39762 - DNA, 16 bp, Artificial Sequence
  synthetic [barcode part1]
caacctagtggaggtg

SEQ ID NO: 39763 - DNA, 16 bp, Artificial Sequence
  synthetic [barcode part1]
cgacacgactatcctc

SEQ ID NO: 39764 - DNA, 16 bp, Artificial Sequence
  synthetic [barcode part1]
cgtatcacggttacag

SEQ ID NO: 39765 - DNA, 16 bp, Artificial Sequence
  synthetic [barcode part1]
cgaactatcctgtatc

SEQ ID NO: 39766 - DNA, 16 bp, Artificial Sequence
  synthetic [barcode part1]
gcagttacaatcgtgc

SEQ ID NO: 39767 - DNA, 16 bp, Artificial Sequence
  synthetic [barcode part1]
gcggttaaggatcggt

SEQ ID NO: 39768 - DNA, 16 bp, Artificial Sequence
  synthetic [barcode part1]
actaagttctgtgcct

SEQ ID NO: 39769 - DNA, 16 bp, Artificial Sequence
  synthetic [barcode part1]
gaccggcacgtatatt

SEQ ID NO: 39770 - DNA, 16 bp, Artificial Sequence
  synthetic [barcode part1]
tactactacgaggtgc

SEQ ID NO: 39771 - DNA, 16 bp, Artificial Sequence
  synthetic [barcode part1]
tgaatactgcggacct

SEQ ID NO: 39772 - DNA, 16 bp, Artificial Sequence
  synthetic [barcode part1]
cgcagattccaccgtt

SEQ ID NO: 39773 - DNA, 16 bp, Artificial Sequence
  synthetic [barcode part1]
gacgagaccttactac

SEQ ID NO: 39774 - DNA, 16 bp, Artificial Sequence
  synthetic [barcode part1]
gtcaagtcggagacac

SEQ ID NO: 39775 - DNA, 16 bp, Artificial Sequence
  synthetic [barcode part1]
tctcagtggagactgt

SEQ ID NO: 39776 - DNA, 16 bp, Artificial Sequence
  synthetic [barcode part1]
gattacggatctcttc

SEQ ID NO: 39777 - DNA, 16 bp, Artificial Sequence
  synthetic [barcode part1]
atacacaggttggcct

SEQ ID NO: 39778 - DNA, 16 bp, Artificial Sequence
  synthetic [barcode part1]
gtagtcggcgtattgt

SEQ ID NO: 39779 - DNA, 16 bp, Artificial Sequence
  synthetic [barcode part1]
acctcctaatcaggag

SEQ ID NO: 39780 - DNA, 16 bp, Artificial Sequence
  synthetic [barcode part1]
cgaattgtcctcgcac

SEQ ID NO: 39781 - DNA, 16 bp, Artificial Sequence
  synthetic [barcode part1]
agtcaactacgcgtac

SEQ ID NO: 39782 - DNA, 16 bp, Artificial Sequence
  synthetic [barcode part1]
tctaactatacaccgc

SEQ ID NO: 39783 - DNA, 16 bp, Artificial Sequence
  synthetic [barcode part1]
gtcgtagtatccgcct

SEQ ID NO: 39784 - DNA, 16 bp, Artificial Sequence
  synthetic [barcode part1]
aaggattatactggcg

SEQ ID NO: 39785 - DNA, 16 bp, Artificial Sequence
  synthetic [barcode part1]
acgccttaggatacac

SEQ ID NO: 39786 - DNA, 16 bp, Artificial Sequence
  synthetic [barcode part1]
gtgacaccaactggtt

SEQ ID NO: 39787 - DNA, 16 bp, Artificial Sequence
  synthetic [barcode part1]
gatcgcaccttgacct

SEQ ID NO: 39788 - DNA, 16 bp, Artificial Sequence
  synthetic [barcode part1]
caagtgcactagaagt

SEQ ID NO: 39789 - DNA, 16 bp, Artificial Sequence
  synthetic [barcode part1]
tctctccgatcctagt

SEQ ID NO: 39790 - DNA, 16 bp, Artificial Sequence
  synthetic [barcode part1]
tactggagacaactcc

SEQ ID NO: 39791 - DNA, 16 bp, Artificial Sequence
  synthetic [barcode part1]
tgcctacgtaatatcc

SEQ ID NO: 39792 - DNA, 16 bp, Artificial Sequence
  synthetic [barcode part1]
tcgtatcgcaacttgt

SEQ ID NO: 39793 - DNA, 16 bp, Artificial Sequence
  synthetic [barcode part1]
tgcgttccttgataac

SEQ ID NO: 39794 - DNA, 16 bp, Artificial Sequence
  synthetic [barcode part1]
taatcaacggttggcc

SEQ ID NO: 39795 - DNA, 16 bp, Artificial Sequence
  synthetic [barcode part1]
atctctgttcgcgtct

SEQ ID NO: 39796 - DNA, 16 bp, Artificial Sequence
  synthetic [barcode part1]
tggttctcgtaactgt

SEQ ID NO: 39797 - DNA, 16 bp, Artificial Sequence
  synthetic [barcode part1]
aacaagtgtaacaccg

SEQ ID NO: 39798 - DNA, 16 bp, Artificial Sequence
  synthetic [barcode part1]
atagaagtctcgtgcc

SEQ ID NO: 39799 - DNA, 16 bp, Artificial Sequence
  synthetic [barcode part1]
cacaagtaacacctgc

SEQ ID NO: 39800 - DNA, 16 bp, Artificial Sequence
  synthetic [barcode part1]
gtgtcgagactgtact

SEQ ID NO: 39801 - DNA, 16 bp, Artificial Sequence
  synthetic [barcode part1]
tcctctccttcgaagt

SEQ ID NO: 39802 - DNA, 16 bp, Artificial Sequence
  synthetic [barcode part1]
gagacgactatcttgc

SEQ ID NO: 39803 - DNA, 16 bp, Artificial Sequence
  synthetic [barcode part1]
taatcggtagttggcc

SEQ ID NO: 39804 - DNA, 16 bp, Artificial Sequence
  synthetic [barcode part1]
cactgttatctggact

SEQ ID NO: 39805 - DNA, 16 bp, Artificial Sequence
  synthetic [barcode part1]
ccttaagagtactgcg

SEQ ID NO: 39806 - DNA, 16 bp, Artificial Sequence
  synthetic [barcode part1]
ttgaagtaggcctcgt

SEQ ID NO: 39807 - DNA, 16 bp, Artificial Sequence
  synthetic [barcode part1]
ttatcgcgaacctgtt

SEQ ID NO: 39808 - DNA, 16 bp, Artificial Sequence
  synthetic [barcode part1]
cagtccttctcgattc

SEQ ID NO: 39809 - DNA, 16 bp, Artificial Sequence
  synthetic [barcode part1]
aagtcaacacggttag

SEQ ID NO: 39810 - DNA, 16 bp, Artificial Sequence
  synthetic [barcode part1]
gaggcgacgttcaagt

SEQ ID NO: 39811 - DNA, 16 bp, Artificial Sequence
  synthetic [barcode part1]
acacgacgcgtattgt

SEQ ID NO: 39812 - DNA, 16 bp, Artificial Sequence
  synthetic [barcode part1]
cgttctctggcaactg

SEQ ID NO: 39813 - DNA, 16 bp, Artificial Sequence
  synthetic [barcode part1]
cgtctaacggtgagag

SEQ ID NO: 39814 - DNA, 16 bp, Artificial Sequence
  synthetic [barcode part1]
cactctgtcacgaacc

SEQ ID NO: 39815 - DNA, 16 bp, Artificial Sequence
  synthetic [barcode part1]
atctaggccgtagatc

SEQ ID NO: 39816 - DNA, 16 bp, Artificial Sequence
  synthetic [barcode part1]
tcggtatctggccttg

SEQ ID NO: 39817 - DNA, 16 bp, Artificial Sequence
  synthetic [barcode part1]
tcctgtcgcgaattcg

SEQ ID NO: 39818 - DNA, 16 bp, Artificial Sequence
  synthetic [barcode part1]
ttctggaatctatccg

SEQ ID NO: 39819 - DNA, 16 bp, Artificial Sequence
  synthetic [barcode part1]
gatcgatctgagactc

SEQ ID NO: 39820 - DNA, 16 bp, Artificial Sequence
  synthetic [barcode part1]
tgatacgcgatcctcc

SEQ ID NO: 39821 - DNA, 16 bp, Artificial Sequence
  synthetic [barcode part1]
taaggtacgtcaacag

SEQ ID NO: 39822 - DNA, 16 bp, Artificial Sequence
  synthetic [barcode part1]
tgtgtgttgactggtg

SEQ ID NO: 39823 - DNA, 16 bp, Artificial Sequence
  synthetic [barcode part1]
tcaggtagtcctattc

SEQ ID NO: 39824 - DNA, 16 bp, Artificial Sequence
  synthetic [barcode part1]
ttagacggcgacgaac

SEQ ID NO: 39825 - DNA, 16 bp, Artificial Sequence
  synthetic [barcode part1]
agacggttaacggaag

SEQ ID NO: 39826 - DNA, 16 bp, Artificial Sequence
  synthetic [barcode part1]
gcgtattcggagagtg

SEQ ID NO: 39827 - DNA, 16 bp, Artificial Sequence
  synthetic [barcode part1]
ttcgtaccaactcagt

SEQ ID NO: 39828 - DNA, 16 bp, Artificial Sequence
  synthetic [barcode part1]
agaacctataggcggc

SEQ ID NO: 39829 - DNA, 16 bp, Artificial Sequence
  synthetic [barcode part1]
gtgattggcgtatcac

SEQ ID NO: 39830 - DNA, 16 bp, Artificial Sequence
  synthetic [barcode part1]
ttagaccactaggtcg

SEQ ID NO: 39831 - DNA, 16 bp, Artificial Sequence
  synthetic [barcode part1]
tcttcagattacgcgt

SEQ ID NO: 39832 - DNA, 16 bp, Artificial Sequence
  synthetic [barcode part1]
cactggcaaggaatcg

SEQ ID NO: 39833 - DNA, 16 bp, Artificial Sequence
  synthetic [barcode part1]
tatcttggacggagtc

SEQ ID NO: 39834 - DNA, 16 bp, Artificial Sequence
  synthetic [barcode part1]
caataagacctcaccg

SEQ ID NO: 39835 - DNA, 16 bp, Artificial Sequence
  synthetic [barcode part1]
ttgttactcgcagatc

SEQ ID NO: 39836 - DNA, 16 bp, Artificial Sequence
  synthetic [barcode part1]
gatcaactacgtgtgc

SEQ ID NO: 39837 - DNA, 16 bp, Artificial Sequence
  synthetic [barcode part1]
accagtggcaactgtt

SEQ ID NO: 39838 - DNA, 16 bp, Artificial Sequence
  synthetic [barcode part1]
attcggttaacggtcg

SEQ ID NO: 39839 - DNA, 16 bp, Artificial Sequence
  synthetic [barcode part1]
ccagtaagttcctgcc

SEQ ID NO: 39840 - DNA, 16 bp, Artificial Sequence
  synthetic [barcode part1]
gttacttccacagatc

SEQ ID NO: 39841 - DNA, 16 bp, Artificial Sequence
  synthetic [barcode part1]
cctgcgtctaagtcgt

SEQ ID NO: 39842 - DNA, 16 bp, Artificial Sequence
  synthetic [barcode part1]
tggcacactcctgact

SEQ ID NO: 39843 - DNA, 16 bp, Artificial Sequence
  synthetic [barcode part1]
tggtgttgtccactcg

SEQ ID NO: 39844 - DNA, 16 bp, Artificial Sequence
  synthetic [barcode part1]
cagtggtaccagactt

SEQ ID NO: 39845 - DNA, 16 bp, Artificial Sequence
  synthetic [barcode part1]
aggcaactacgagtcg

SEQ ID NO: 39846 - DNA, 16 bp, Artificial Sequence
  synthetic [barcode part1]
acttctaccactgaac

SEQ ID NO: 39847 - DNA, 16 bp, Artificial Sequence
  synthetic [barcode part1]
agaccttgaccttgag

SEQ ID NO: 39848 - DNA, 16 bp, Artificial Sequence
  synthetic [barcode part1]
tctctaacttcggtcc

SEQ ID NO: 39849 - DNA, 16 bp, Artificial Sequence
  synthetic [barcode part1]
ataagacggatctacg

SEQ ID NO: 39850 - DNA, 16 bp, Artificial Sequence
  synthetic [barcode part1]
ataccttccagattgc

SEQ ID NO: 39851 - DNA, 16 bp, Artificial Sequence
  synthetic [barcode part1]
gttggatcaagaacac

SEQ ID NO: 39852 - DNA, 16 bp, Artificial Sequence
  synthetic [barcode part1]
tcactccactgttctg

SEQ ID NO: 39853 - DNA, 16 bp, Artificial Sequence
  synthetic [barcode part1]
gcgttaagacttgcac

SEQ ID NO: 39854 - DNA, 16 bp, Artificial Sequence
  synthetic [barcode part1]
aggccaattctgactg

SEQ ID NO: 39855 - DNA, 16 bp, Artificial Sequence
  synthetic [barcode part1]
cgtgtggagtatatcc

SEQ ID NO: 39856 - DNA, 16 bp, Artificial Sequence
  synthetic [barcode part1]
gtaccaatcttatcgc

SEQ ID NO: 39857 - DNA, 16 bp, Artificial Sequence
  synthetic [barcode part1]
agacctaactctctac

SEQ ID NO: 39858 - DNA, 16 bp, Artificial Sequence
  synthetic [barcode part1]
accacttgcggacctt

SEQ ID NO: 39859 - DNA, 16 bp, Artificial Sequence
  synthetic [barcode part1]
accagttaactggtcg

SEQ ID NO: 39860 - DNA, 16 bp, Artificial Sequence
  synthetic [barcode part1]
attcgcctattgtgac

SEQ ID NO: 39861 - DNA, 16 bp, Artificial Sequence
  synthetic [barcode part1]
tacactctaccgaact

SEQ ID NO: 39862 - DNA, 16 bp, Artificial Sequence
  synthetic [barcode part1]
cgtgaacaacgagatt

SEQ ID NO: 39863 - DNA, 16 bp, Artificial Sequence
  synthetic [barcode part1]
gtattgaggaagtcgt

SEQ ID NO: 39864 - DNA, 16 bp, Artificial Sequence
  synthetic [barcode part1]
atagagaggtcactac

SEQ ID NO: 39865 - DNA, 16 bp, Artificial Sequence
  synthetic [barcode part1]
actgcaactcgtctgc

SEQ ID NO: 39866 - DNA, 16 bp, Artificial Sequence
  synthetic [barcode part1]
agtgaagacgcgacct

SEQ ID NO: 39867 - DNA, 16 bp, Artificial Sequence
  synthetic [barcode part1]
acgtctcaactcggtc

SEQ ID NO: 39868 - DNA, 16 bp, Artificial Sequence
  synthetic [barcode part1]
gaggcctaacgagtac

SEQ ID NO: 39869 - DNA, 16 bp, Artificial Sequence
  synthetic [barcode part1]
cactcaatcaagtgcg

SEQ ID NO: 39870 - DNA, 16 bp, Artificial Sequence
  synthetic [barcode part1]
acaattgacgcgtcgt

SEQ ID NO: 39871 - DNA, 16 bp, Artificial Sequence
  synthetic [barcode part1]
gtcactaccttgtgcg

SEQ ID NO: 39872 - DNA, 16 bp, Artificial Sequence
  synthetic [barcode part1]
ttgacgttcttagtcg

SEQ ID NO: 39873 - DNA, 16 bp, Artificial Sequence
  synthetic [barcode part1]
gagattcgtagtgtcc

SEQ ID NO: 39874 - DNA, 16 bp, Artificial Sequence
  synthetic [barcode part1]
gattcctatacggtct

SEQ ID NO: 39875 - DNA, 16 bp, Artificial Sequence
  synthetic [barcode part1]
gagattatcagacacg

SEQ ID NO: 39876 - DNA, 16 bp, Artificial Sequence
  synthetic [barcode part1]
agatccttgtaacgcg

SEQ ID NO: 39877 - DNA, 16 bp, Artificial Sequence
  synthetic [barcode part1]
cggtgtctattgtgag

SEQ ID NO: 39878 - DNA, 16 bp, Artificial Sequence
  synthetic [barcode part1]
ttggagttggagtctc

SEQ ID NO: 39879 - DNA, 16 bp, Artificial Sequence
  synthetic [barcode part1]
ttgcactcggattgtt

SEQ ID NO: 39880 - DNA, 16 bp, Artificial Sequence
  synthetic [barcode part1]
acttgagagactcacc

SEQ ID NO: 39881 - DNA, 16 bp, Artificial Sequence
  synthetic [barcode part1]
ttatcggtacaggaag

SEQ ID NO: 39882 - DNA, 16 bp, Artificial Sequence
  synthetic [barcode part1]
ttctgatccaggtgcc

SEQ ID NO: 39883 - DNA, 16 bp, Artificial Sequence
  synthetic [barcode part1]
gaagtattcggtaacg

SEQ ID NO: 39884 - DNA, 16 bp, Artificial Sequence
  synthetic [barcode part1]
gatataggtctctgcg

SEQ ID NO: 39885 - DNA, 16 bp, Artificial Sequence
  synthetic [barcode part1]
tgactctaccgtgcgt

SEQ ID NO: 39886 - DNA, 16 bp, Artificial Sequence
  synthetic [barcode part1]
taccactgacgcgtct

SEQ ID NO: 39887 - DNA, 16 bp, Artificial Sequence
  synthetic [barcode part1]
gcgttaattggacgtc

SEQ ID NO: 39888 - DNA, 16 bp, Artificial Sequence
  synthetic [barcode part1]
gagtacgcgatccaag

SEQ ID NO: 39889 - DNA, 16 bp, Artificial Sequence
  synthetic [barcode part1]
attcactctgtccgtc

SEQ ID NO: 39890 - DNA, 16 bp, Artificial Sequence
  synthetic [barcode part1]
acacggaatagtctag

SEQ ID NO: 39891 - DNA, 16 bp, Artificial Sequence
  synthetic [barcode part1]
acaggccttctgtcac

SEQ ID NO: 39892 - DNA, 16 bp, Artificial Sequence
  synthetic [barcode part1]
gccacagtggatagac

SEQ ID NO: 39893 - DNA, 16 bp, Artificial Sequence
  synthetic [barcode part1]
tgtcgccacaaccact

SEQ ID NO: 39894 - DNA, 16 bp, Artificial Sequence
  synthetic [barcode part1]
aaggttagtgcctaag

SEQ ID NO: 39895 - DNA, 16 bp, Artificial Sequence
  synthetic [barcode part1]
ccactgtctgtagacc

SEQ ID NO: 39896 - DNA, 16 bp, Artificial Sequence
  synthetic [barcode part1]
gtcactacgacaatcg

SEQ ID NO: 39897 - DNA, 16 bp, Artificial Sequence
  synthetic [barcode part1]
acctactagaccttgt

SEQ ID NO: 39898 - DNA, 16 bp, Artificial Sequence
  synthetic [barcode part1]
gtgtatccacctcacg

SEQ ID NO: 39899 - DNA, 16 bp, Artificial Sequence
  synthetic [barcode part1]
ttacctggcggtgtct

SEQ ID NO: 39900 - DNA, 16 bp, Artificial Sequence
  synthetic [barcode part1]
ccaatcagagacttcg

SEQ ID NO: 39901 - DNA, 16 bp, Artificial Sequence
  synthetic [barcode part1]
gcgtgcaatatcacac

SEQ ID NO: 39902 - DNA, 16 bp, Artificial Sequence
  synthetic [barcode part1]
tcgcaggtcgttatcc

SEQ ID NO: 39903 - DNA, 16 bp, Artificial Sequence
  synthetic [barcode part1]
attcctgccgtcaggt

SEQ ID NO: 39904 - DNA, 16 bp, Artificial Sequence
  synthetic [barcode part1]
tacgttcttcgcgtct

SEQ ID NO: 39905 - DNA, 16 bp, Artificial Sequence
  synthetic [barcode part1]
cacacaggagtacctt

SEQ ID NO: 39906 - DNA, 16 bp, Artificial Sequence
  synthetic [barcode part1]
ataggtcagttgtgcc

SEQ ID NO: 39907 - DNA, 16 bp, Artificial Sequence
  synthetic [barcode part1]
tgaccaggcgtgtatt

SEQ ID NO: 39908 - DNA, 16 bp, Artificial Sequence
  synthetic [barcode part1]
aagtgatcgcagattg

SEQ ID NO: 39909 - DNA, 16 bp, Artificial Sequence
  synthetic [barcode part1]
cctaatcggtccttct

SEQ ID NO: 39910 - DNA, 16 bp, Artificial Sequence
  synthetic [barcode part1]
gagttcgtcgttgcct

SEQ ID NO: 39911 - DNA, 16 bp, Artificial Sequence
  synthetic [barcode part1]
tcggcaaggattacct

SEQ ID NO: 39912 - DNA, 16 bp, Artificial Sequence
  synthetic [barcode part1]
ccttaactacaccagt

SEQ ID NO: 39913 - DNA, 16 bp, Artificial Sequence
  synthetic [barcode part1]
tcacagtgatcggttg

SEQ ID NO: 39914 - DNA, 16 bp, Artificial Sequence
  synthetic [barcode part1]
gtgattgcaattgcgc

SEQ ID NO: 39915 - DNA, 16 bp, Artificial Sequence
  synthetic [barcode part1]
tcgttccaatctgtag

SEQ ID NO: 39916 - DNA, 16 bp, Artificial Sequence
  synthetic [barcode part1]
agtccggactgaattc

SEQ ID NO: 39917 - DNA, 16 bp, Artificial Sequence
  synthetic [barcode part1]
tgcgttataacgcgtg

SEQ ID NO: 39918 - DNA, 16 bp, Artificial Sequence
  synthetic [barcode part1]
atcgccgattaggttg

SEQ ID NO: 39919 - DNA, 16 bp, Artificial Sequence
  synthetic [barcode part1]
taccgttacggccgtt

SEQ ID NO: 39920 - DNA, 16 bp, Artificial Sequence
  synthetic [barcode part1]
gtaatcgtgcagtcac

SEQ ID NO: 39921 - DNA, 16 bp, Artificial Sequence
  synthetic [barcode part1]
gaactcgaggtgttct

SEQ ID NO: 39922 - DNA, 16 bp, Artificial Sequence
  synthetic [barcode part1]
cagaaccgtgttacgt

SEQ ID NO: 39923 - DNA, 16 bp, Artificial Sequence
  synthetic [barcode part1]
ttcctcgtactaacag

SEQ ID NO: 39924 - DNA, 16 bp, Artificial Sequence
  synthetic [barcode part1]
aactgtggacttcttc

SEQ ID NO: 39925 - DNA, 16 bp, Artificial Sequence
  synthetic [barcode part1]
taggccacgcacttct

SEQ ID NO: 39926 - DNA, 16 bp, Artificial Sequence
  synthetic [barcode part1]
ttggtcctctacggac

SEQ ID NO: 39927 - DNA, 16 bp, Artificial Sequence
  synthetic [barcode part1]
tacttaagaggcggcg

SEQ ID NO: 39928 - DNA, 16 bp, Artificial Sequence
  synthetic [barcode part1]
cactctcactactaag

SEQ ID NO: 39929 - DNA, 16 bp, Artificial Sequence
  synthetic [barcode part1]
acagtggaacagtgag

SEQ ID NO: 39930 - DNA, 16 bp, Artificial Sequence
  synthetic [barcode part1]
ataccaggttatctcc

SEQ ID NO: 39931 - DNA, 16 bp, Artificial Sequence
  synthetic [barcode part1]
caggtgtagaagttgt

SEQ ID NO: 39932 - DNA, 16 bp, Artificial Sequence
  synthetic [barcode part1]
gcgtcagttcttaatc

SEQ ID NO: 39933 - DNA, 16 bp, Artificial Sequence
  synthetic [barcode part1]
gagttggagaaggttg

SEQ ID NO: 39934 - DNA, 16 bp, Artificial Sequence
  synthetic [barcode part1]
ttactggcacgaggag

SEQ ID NO: 39935 - DNA, 16 bp, Artificial Sequence
  synthetic [barcode part1]
tagtatacgcggactc

SEQ ID NO: 39936 - DNA, 16 bp, Artificial Sequence
  synthetic [barcode part1]
atagaagaccgaactc

SEQ ID NO: 39937 - DNA, 16 bp, Artificial Sequence
  synthetic [barcode part1]
tcactgtggtggagtt

SEQ ID NO: 39938 - DNA, 16 bp, Artificial Sequence
  synthetic [barcode part1]
aggattcctcgtccac

SEQ ID NO: 39939 - DNA, 16 bp, Artificial Sequence
  synthetic [barcode part1]
cactattcggaggatc

SEQ ID NO: 39940 - DNA, 16 bp, Artificial Sequence
  synthetic [barcode part1]
cgaattaccggatcgt

SEQ ID NO: 39941 - DNA, 16 bp, Artificial Sequence
  synthetic [barcode part1]
ccttggtatcgttctc

SEQ ID NO: 39942 - DNA, 16 bp, Artificial Sequence
  synthetic [barcode part1]
tgagatacgttgacag

SEQ ID NO: 39943 - DNA, 16 bp, Artificial Sequence
  synthetic [barcode part1]
cactggattgtcaggt

SEQ ID NO: 39944 - DNA, 16 bp, Artificial Sequence
  synthetic [barcode part1]
agacggaagtagacac

SEQ ID NO: 39945 - DNA, 16 bp, Artificial Sequence
  synthetic [barcode part1]
tctgtcgttgagtatc

SEQ ID NO: 39946 - DNA, 16 bp, Artificial Sequence
  synthetic [barcode part1]
gatactcgttcaggtg

SEQ ID NO: 39947 - DNA, 16 bp, Artificial Sequence
  synthetic [barcode part1]
tggttccgtgcgttac

SEQ ID NO: 39948 - DNA, 16 bp, Artificial Sequence
  synthetic [barcode part1]
tccaattgactcctcc

SEQ ID NO: 39949 - DNA, 16 bp, Artificial Sequence
  synthetic [barcode part1]
ttagacacgtcactct

SEQ ID NO: 39950 - DNA, 16 bp, Artificial Sequence
  synthetic [barcode part1]
cgcagtaggacaggtt

SEQ ID NO: 39951 - DNA, 16 bp, Artificial Sequence
  synthetic [barcode part1]
ccggaatcgagatctt

SEQ ID NO: 39952 - DNA, 16 bp, Artificial Sequence
  synthetic [barcode part1]
tgaaggcgtctaatag

SEQ ID NO: 39953 - DNA, 16 bp, Artificial Sequence
  synthetic [barcode part1]
cgagtacttctgttgt

SEQ ID NO: 39954 - DNA, 16 bp, Artificial Sequence
  synthetic [barcode part1]
caacgtggattcgtgt

SEQ ID NO: 39955 - DNA, 16 bp, Artificial Sequence
  synthetic [barcode part1]
aggcctactgtcgtct

SEQ ID NO: 39956 - DNA, 16 bp, Artificial Sequence
  synthetic [barcode part1]
aatccgtggatctacg

SEQ ID NO: 39957 - DNA, 16 bp, Artificial Sequence
  synthetic [barcode part1]
cacacaatcgtacgac

SEQ ID NO: 39958 - DNA, 16 bp, Artificial Sequence
  synthetic [barcode part1]
caacaacctagaccac

SEQ ID NO: 39959 - DNA, 16 bp, Artificial Sequence
  synthetic [barcode part1]
cgccttacttattgcc

SEQ ID NO: 39960 - DNA, 16 bp, Artificial Sequence
  synthetic [barcode part1]
taagaccgaagtctcc

SEQ ID NO: 39961 - DNA, 16 bp, Artificial Sequence
  synthetic [barcode part1]
tactccgacgatagac

SEQ ID NO: 39962 - DNA, 16 bp, Artificial Sequence
  synthetic [barcode part1]
gaacgtgaactgttag

SEQ ID NO: 39963 - DNA, 16 bp, Artificial Sequence
  synthetic [barcode part1]
cgagagatagtgtgcc

SEQ ID NO: 39964 - DNA, 16 bp, Artificial Sequence
  synthetic [barcode part1]
actggtaattcggacc

SEQ ID NO: 39965 - DNA, 16 bp, Artificial Sequence
  synthetic [barcode part1]
gaacgcaactaggtcg

SEQ ID NO: 39966 - DNA, 16 bp, Artificial Sequence
  synthetic [barcode part1]
tacctacttcgtccgt

SEQ ID NO: 39967 - DNA, 16 bp, Artificial Sequence
  synthetic [barcode part1]
cctcacaggttcagtc

SEQ ID NO: 39968 - DNA, 16 bp, Artificial Sequence
  synthetic [barcode part1]
gtggtgaacgagatag

SEQ ID NO: 39969 - DNA, 16 bp, Artificial Sequence
  synthetic [barcode part1]
tctcctccagtatcgt

SEQ ID NO: 39970 - DNA, 16 bp, Artificial Sequence
  synthetic [barcode part1]
acagtacgtgttgcac

SEQ ID NO: 39971 - DNA, 16 bp, Artificial Sequence
  synthetic [barcode part1]
gaagacaggcggtctt

SEQ ID NO: 39972 - DNA, 16 bp, Artificial Sequence
  synthetic [barcode part1]
atagagattgacggtc

SEQ ID NO: 39973 - DNA, 16 bp, Artificial Sequence
  synthetic [barcode part1]
tcctccagtaaccgtg

SEQ ID NO: 39974 - DNA, 16 bp, Artificial Sequence
  synthetic [barcode part1]
gaacttgtgtctcgcc

SEQ ID NO: 39975 - DNA, 16 bp, Artificial Sequence
  synthetic [barcode part1]
acgactagttaacgcc

SEQ ID NO: 39976 - DNA, 16 bp, Artificial Sequence
  synthetic [barcode part1]
tagaactccgatcggt

SEQ ID NO: 39977 - DNA, 16 bp, Artificial Sequence
  synthetic [barcode part1]
cctagttcggtgcact

SEQ ID NO: 39978 - DNA, 16 bp, Artificial Sequence
  synthetic [barcode part1]
tctgcgtgtcgaatcc

SEQ ID NO: 39979 - DNA, 16 bp, Artificial Sequence
  synthetic [barcode part1]
tctaacggaacgtaag

SEQ ID NO: 39980 - DNA, 16 bp, Artificial Sequence
  synthetic [barcode part1]
gtgtggttcttccggt

SEQ ID NO: 39981 - DNA, 16 bp, Artificial Sequence
  synthetic [barcode part1]
ttgtgagacaggatac

SEQ ID NO: 39982 - DNA, 16 bp, Artificial Sequence
  synthetic [barcode part1]
tcggttcgtggttgtc

SEQ ID NO: 39983 - DNA, 16 bp, Artificial Sequence
  synthetic [barcode part1]
aatccggacgtcctct

SEQ ID NO: 39984 - DNA, 16 bp, Artificial Sequence
  synthetic [barcode part1]
caacctatcacgcctg

SEQ ID NO: 39985 - DNA, 16 bp, Artificial Sequence
  synthetic [barcode part1]
acaggtcctctcaatt

SEQ ID NO: 39986 - DNA, 16 bp, Artificial Sequence
  synthetic [barcode part1]
ccagaaggttaaggag

SEQ ID NO: 39987 - DNA, 16 bp, Artificial Sequence
  synthetic [barcode part1]
tatcttcggtccgacg

SEQ ID NO: 39988 - DNA, 16 bp, Artificial Sequence
  synthetic [barcode part1]
tcacgtcaacgacctc

SEQ ID NO: 39989 - DNA, 16 bp, Artificial Sequence
  synthetic [barcode part1]
ttatctcacgcgaccg

SEQ ID NO: 39990 - DNA, 16 bp, Artificial Sequence
  synthetic [barcode part1]
gactatctatcaggcg

SEQ ID NO: 39991 - DNA, 16 bp, Artificial Sequence
  synthetic [barcode part1]
gacgtactcttgatct

SEQ ID NO: 39992 - DNA, 16 bp, Artificial Sequence
  synthetic [barcode part1]
tgacttgtgtcaggtg

SEQ ID NO: 39993 - DNA, 16 bp, Artificial Sequence
  synthetic [barcode part1]
gatcgagacaatcgcg

SEQ ID NO: 39994 - DNA, 16 bp, Artificial Sequence
  synthetic [barcode part1]
aggtcaggtcaacgtg

SEQ ID NO: 39995 - DNA, 16 bp, Artificial Sequence
  synthetic [barcode part1]
aggtgtcgatacctgt

SEQ ID NO: 39996 - DNA, 16 bp, Artificial Sequence
  synthetic [barcode part1]
gtagtgcaccgcaatt

SEQ ID NO: 39997 - DNA, 16 bp, Artificial Sequence
  synthetic [barcode part1]
tataccgttccaactg

SEQ ID NO: 39998 - DNA, 16 bp, Artificial Sequence
  synthetic [barcode part1]
tatacctaggcgtgac

SEQ ID NO: 39999 - DNA, 16 bp, Artificial Sequence
  synthetic [barcode part1]
cactctgcactacttc

SEQ ID NO: 40000 - DNA, 16 bp, Artificial Sequence
  synthetic [barcode part1]
gttgtggtattcgtct

SEQ ID NO: 40001 - DNA, 16 bp, Artificial Sequence
  synthetic [barcode part1]
aactcgtgtggtggag

SEQ ID NO: 40002 - DNA, 16 bp, Artificial Sequence
  synthetic [barcode part1]
agacgtgccgagttag

SEQ ID NO: 40003 - DNA, 16 bp, Artificial Sequence
  synthetic [barcode part1]
atacgcggtacgtact

SEQ ID NO: 40004 - DNA, 16 bp, Artificial Sequence
  synthetic [barcode part1]
ttccaagtgcctgtcg

SEQ ID NO: 40005 - DNA, 16 bp, Artificial Sequence
  synthetic [barcode part1]
ttgatcctaccaacgt

SEQ ID NO: 40006 - DNA, 16 bp, Artificial Sequence
  synthetic [barcode part1]
atcctatcaccttgcc

SEQ ID NO: 40007 - DNA, 16 bp, Artificial Sequence
  synthetic [barcode part1]
ttagagaaggacgacg

SEQ ID NO: 40008 - DNA, 16 bp, Artificial Sequence
  synthetic [barcode part1]
acagatattcgagacg

SEQ ID NO: 40009 - DNA, 16 bp, Artificial Sequence
  synthetic [barcode part1]
gcaacgatactctgtg

SEQ ID NO: 40010 - DNA, 16 bp, Artificial Sequence
  synthetic [barcode part1]
tgttcaccgcctatct

SEQ ID NO: 40011 - DNA, 16 bp, Artificial Sequence
  synthetic [barcode part1]
actcaagtgagacggc

SEQ ID NO: 40012 - DNA, 16 bp, Artificial Sequence
  synthetic [barcode part1]
atagaggccggcagtt

SEQ ID NO: 40013 - DNA, 16 bp, Artificial Sequence
  synthetic [barcode part1]
tcgagttcttcacgcg

SEQ ID NO: 40014 - DNA, 16 bp, Artificial Sequence
  synthetic [barcode part1]
acttgcctctaagatc

SEQ ID NO: 40015 - DNA, 16 bp, Artificial Sequence
  synthetic [barcode part1]
tacgttgaccaacacg

SEQ ID NO: 40016 - DNA, 16 bp, Artificial Sequence
  synthetic [barcode part1]
attcaaggtccgcagt

SEQ ID NO: 40017 - DNA, 16 bp, Artificial Sequence
  synthetic [barcode part1]
cactcacagatcttac

SEQ ID NO: 40018 - DNA, 16 bp, Artificial Sequence
  synthetic [barcode part1]
caagttgttaacggcc

SEQ ID NO: 40019 - DNA, 16 bp, Artificial Sequence
  synthetic [barcode part1]
cactcgtatagtatcc

SEQ ID NO: 40020 - DNA, 16 bp, Artificial Sequence
  synthetic [barcode part1]
gactgttgcaaggacg

SEQ ID NO: 40021 - DNA, 16 bp, Artificial Sequence
  synthetic [barcode part1]
gaggccttactcgttc

SEQ ID NO: 40022 - DNA, 16 bp, Artificial Sequence
  synthetic [barcode part1]
gttgtcagttggactg

SEQ ID NO: 40023 - DNA, 16 bp, Artificial Sequence
  synthetic [barcode part1]
gactggattgtacaag

SEQ ID NO: 40024 - DNA, 16 bp, Artificial Sequence
  synthetic [barcode part1]
gacttgagacctgatc

SEQ ID NO: 40025 - DNA, 16 bp, Artificial Sequence
  synthetic [barcode part1]
cgataacaggagtgcc

SEQ ID NO: 40026 - DNA, 16 bp, Artificial Sequence
  synthetic [barcode part1]
cagatcttgccgttcg

SEQ ID NO: 40027 - DNA, 16 bp, Artificial Sequence
  synthetic [barcode part1]
gttcttacgtcttcgc

SEQ ID NO: 40028 - DNA, 16 bp, Artificial Sequence
  synthetic [barcode part1]
cgatacgcgtagactt

SEQ ID NO: 40029 - DNA, 16 bp, Artificial Sequence
  synthetic [barcode part1]
gcctatctgttacggc

SEQ ID NO: 40030 - DNA, 16 bp, Artificial Sequence
  synthetic [barcode part1]
tgttgccaggtactcc

SEQ ID NO: 40031 - DNA, 16 bp, Artificial Sequence
  synthetic [barcode part1]
caacttggaatcgtcg

SEQ ID NO: 40032 - DNA, 16 bp, Artificial Sequence
  synthetic [barcode part1]
tactctaggtacttgc

SEQ ID NO: 40033 - DNA, 16 bp, Artificial Sequence
  synthetic [barcode part1]
ttaatctccacgtggt

SEQ ID NO: 40034 - DNA, 16 bp, Artificial Sequence
  synthetic [barcode part1]
tgtcaacctgaagaag

SEQ ID NO: 40035 - DNA, 16 bp, Artificial Sequence
  synthetic [barcode part1]
tcttacggttgccggt

SEQ ID NO: 40036 - DNA, 16 bp, Artificial Sequence
  synthetic [barcode part1]
gtgcgcgattacaact

SEQ ID NO: 40037 - DNA, 16 bp, Artificial Sequence
  synthetic [barcode part1]
cctactatcctcgact

SEQ ID NO: 40038 - DNA, 16 bp, Artificial Sequence
  synthetic [barcode part1]
agttcacttcgtcgcg

SEQ ID NO: 40039 - DNA, 16 bp, Artificial Sequence
  synthetic [barcode part1]
aacgcgaacaagaacg

SEQ ID NO: 40040 - DNA, 16 bp, Artificial Sequence
  synthetic [barcode part1]
tacttctatcggatcg

SEQ ID NO: 40041 - DNA, 16 bp, Artificial Sequence
  synthetic [barcode part1]
caatacggactacacc

SEQ ID NO: 40042 - DNA, 16 bp, Artificial Sequence
  synthetic [barcode part1]
tagtacgcgtagactc

SEQ ID NO: 40043 - DNA, 16 bp, Artificial Sequence
  synthetic [barcode part1]
tcggttcgcagaatac

SEQ ID NO: 40044 - DNA, 16 bp, Artificial Sequence
  synthetic [barcode part1]
cgtaggtctcgttatt

SEQ ID NO: 40045 - DNA, 16 bp, Artificial Sequence
  synthetic [barcode part1]
tggcaagattccgttg

SEQ ID NO: 40046 - DNA, 16 bp, Artificial Sequence
  synthetic [barcode part1]
atcctagtgcagtacg

SEQ ID NO: 40047 - DNA, 16 bp, Artificial Sequence
  synthetic [barcode part1]
tactggattaccaggc

SEQ ID NO: 40048 - DNA, 16 bp, Artificial Sequence
  synthetic [barcode part1]
agtactgcacagtgtc

SEQ ID NO: 40049 - DNA, 16 bp, Artificial Sequence
  synthetic [barcode part1]
tgtaggcggcaggatt

SEQ ID NO: 40050 - DNA, 16 bp, Artificial Sequence
  synthetic [barcode part1]
tgagtgtgacttgtgc

SEQ ID NO: 40051 - DNA, 16 bp, Artificial Sequence
  synthetic [barcode part1]
tagaattgtaccgcgc

SEQ ID NO: 40052 - DNA, 16 bp, Artificial Sequence
  synthetic [barcode part1]
aggacaatagacacct

SEQ ID NO: 40053 - DNA, 16 bp, Artificial Sequence
  synthetic [barcode part1]
caatagttctccacgt

SEQ ID NO: 40054 - DNA, 16 bp, Artificial Sequence
  synthetic [barcode part1]
gtctagagtggcagac

SEQ ID NO: 40055 - DNA, 16 bp, Artificial Sequence
  synthetic [barcode part1]
acgtgcagatcagtct

SEQ ID NO: 40056 - DNA, 16 bp, Artificial Sequence
  synthetic [barcode part1]
agaacctcttgttcac

SEQ ID NO: 40057 - DNA, 16 bp, Artificial Sequence
  synthetic [barcode part1]
gttagtcgtaccacag

SEQ ID NO: 40058 - DNA, 16 bp, Artificial Sequence
  synthetic [barcode part1]
gagattcaggtggacc

SEQ ID NO: 40059 - DNA, 16 bp, Artificial Sequence
  synthetic [barcode part1]
ccaatccgaatacttc

SEQ ID NO: 40060 - DNA, 16 bp, Artificial Sequence
  synthetic [barcode part1]
acgtaggtgttaggcg

SEQ ID NO: 40061 - DNA, 16 bp, Artificial Sequence
  synthetic [barcode part1]
atatcttcgatccggt

SEQ ID NO: 40062 - DNA, 16 bp, Artificial Sequence
  synthetic [barcode part1]
tatcgagacctaacgc

SEQ ID NO: 40063 - DNA, 16 bp, Artificial Sequence
  synthetic [barcode part1]
gtgttagttccgttac

SEQ ID NO: 40064 - DNA, 16 bp, Artificial Sequence
  synthetic [barcode part1]
cacttacaggtcttgt

SEQ ID NO: 40065 - DNA, 16 bp, Artificial Sequence
  synthetic [barcode part1]
gattacaccagttcct

SEQ ID NO: 40066 - DNA, 16 bp, Artificial Sequence
  synthetic [barcode part1]
gacgtgattacgtctg

SEQ ID NO: 40067 - DNA, 16 bp, Artificial Sequence
  synthetic [barcode part1]
tcttgtatctccgcac

SEQ ID NO: 40068 - DNA, 16 bp, Artificial Sequence
  synthetic [barcode part1]
aggtaccaggcctatt

SEQ ID NO: 40069 - DNA, 16 bp, Artificial Sequence
  synthetic [barcode part1]
taaggccttggaacct

SEQ ID NO: 40070 - DNA, 16 bp, Artificial Sequence
  synthetic [barcode part1]
aaccacgtcctctggt

SEQ ID NO: 40071 - DNA, 16 bp, Artificial Sequence
  synthetic [barcode part1]
cactcggatacttgag

SEQ ID NO: 40072 - DNA, 16 bp, Artificial Sequence
  synthetic [barcode part1]
gtacctacctactgcg

SEQ ID NO: 40073 - DNA, 16 bp, Artificial Sequence
  synthetic [barcode part1]
acactcacacttggag

SEQ ID NO: 40074 - DNA, 16 bp, Artificial Sequence
  synthetic [barcode part1]
acttcttacaccagtg

SEQ ID NO: 40075 - DNA, 16 bp, Artificial Sequence
  synthetic [barcode part1]
agtaccacagtaccac

SEQ ID NO: 40076 - DNA, 16 bp, Artificial Sequence
  synthetic [barcode part1]
ccggtaccaactatag

SEQ ID NO: 40077 - DNA, 16 bp, Artificial Sequence
  synthetic [barcode part1]
cactcgcgaacgaatt

SEQ ID NO: 40078 - DNA, 16 bp, Artificial Sequence
  synthetic [barcode part1]
acaaggaccttcacgt

SEQ ID NO: 40079 - DNA, 16 bp, Artificial Sequence
  synthetic [barcode part1]
tatcttcgcgtggaag

SEQ ID NO: 40080 - DNA, 16 bp, Artificial Sequence
  synthetic [barcode part1]
aagtcgtggtgcgaac

SEQ ID NO: 40081 - DNA, 16 bp, Artificial Sequence
  synthetic [barcode part1]
gtaatcactctctggt

SEQ ID NO: 40082 - DNA, 16 bp, Artificial Sequence
  synthetic [barcode part1]
gcagttggtacgttgt

SEQ ID NO: 40083 - DNA, 16 bp, Artificial Sequence
  synthetic [barcode part1]
gtctgccgtgacactt

SEQ ID NO: 40084 - DNA, 16 bp, Artificial Sequence
  synthetic [barcode part1]
cacgttagagagattg

SEQ ID NO: 40085 - DNA, 16 bp, Artificial Sequence
  synthetic [barcode part1]
ttgaacgccacgaatc

SEQ ID NO: 40086 - DNA, 16 bp, Artificial Sequence
  synthetic [barcode part1]
tcgtagactgtacgac

SEQ ID NO: 40087 - DNA, 16 bp, Artificial Sequence
  synthetic [barcode part1]
accttacagtgcactt

SEQ ID NO: 40088 - DNA, 16 bp, Artificial Sequence
  synthetic [barcode part1]
acacgaggttcgacag

SEQ ID NO: 40089 - DNA, 16 bp, Artificial Sequence
  synthetic [barcode part1]
agacaggtagataggc

SEQ ID NO: 40090 - DNA, 16 bp, Artificial Sequence
  synthetic [barcode part1]
tccttggacacaccac

SEQ ID NO: 40091 - DNA, 16 bp, Artificial Sequence
  synthetic [barcode part1]
acagtcacacagttgc

SEQ ID NO: 40092 - DNA, 16 bp, Artificial Sequence
  synthetic [barcode part1]
aggcctcggttaattg

SEQ ID NO: 40093 - DNA, 16 bp, Artificial Sequence
  synthetic [barcode part1]
agacgaggtctatctc

SEQ ID NO: 40094 - DNA, 16 bp, Artificial Sequence
  synthetic [barcode part1]
attgtgcaactacgcg

SEQ ID NO: 40095 - DNA, 16 bp, Artificial Sequence
  synthetic [barcode part1]
caggtgtattaggagt

SEQ ID NO: 40096 - DNA, 16 bp, Artificial Sequence
  synthetic [barcode part1]
aggtacttgcctagac

SEQ ID NO: 40097 - DNA, 16 bp, Artificial Sequence
  synthetic [barcode part1]
tatcagagagtcgcct

SEQ ID NO: 40098 - DNA, 16 bp, Artificial Sequence
  synthetic [barcode part1]
actcctctgtgattag

SEQ ID NO: 40099 - DNA, 16 bp, Artificial Sequence
  synthetic [barcode part1]
attcttcgcactagtg

SEQ ID NO: 40100 - DNA, 16 bp, Artificial Sequence
  synthetic [barcode part1]
cgccaacaagaggttg

SEQ ID NO: 40101 - DNA, 16 bp, Artificial Sequence
  synthetic [barcode part1]
ttatctcacgcagttg

SEQ ID NO: 40102 - DNA, 16 bp, Artificial Sequence
  synthetic [barcode part1]
tacagtcctccaccag

SEQ ID NO: 40103 - DNA, 16 bp, Artificial Sequence
  synthetic [barcode part1]
ccgacagtgttcttgc

SEQ ID NO: 40104 - DNA, 16 bp, Artificial Sequence
  synthetic [barcode part1]
atctcgtgcagagtgt

SEQ ID NO: 40105 - DNA, 16 bp, Artificial Sequence
  synthetic [barcode part1]
aactaaggacgtgccg

SEQ ID NO: 40106 - DNA, 16 bp, Artificial Sequence
  synthetic [barcode part1]
aggagtccgatacacg

SEQ ID NO: 40107 - DNA, 16 bp, Artificial Sequence
  synthetic [barcode part1]
tcgtctccgtgaatcg

SEQ ID NO: 40108 - DNA, 16 bp, Artificial Sequence
  synthetic [barcode part1]
cctgaatcgagtctag

SEQ ID NO: 40109 - DNA, 16 bp, Artificial Sequence
  synthetic [barcode part1]
ttggcaaggtaacctc

SEQ ID NO: 40110 - DNA, 16 bp, Artificial Sequence
  synthetic [barcode part1]
gcagtatcggtgttac

SEQ ID NO: 40111 - DNA, 16 bp, Artificial Sequence
  synthetic [barcode part1]
tcttggcactaaggac

SEQ ID NO: 40112 - DNA, 16 bp, Artificial Sequence
  synthetic [barcode part1]
aactagattcgtggag

SEQ ID NO: 40113 - DNA, 16 bp, Artificial Sequence
  synthetic [barcode part1]
taggagactctctggt

SEQ ID NO: 40114 - DNA, 16 bp, Artificial Sequence
  synthetic [barcode part1]
tataactggaacggtg

SEQ ID NO: 40115 - DNA, 16 bp, Artificial Sequence
  synthetic [barcode part1]
atctgtgcgtagatcg

SEQ ID NO: 40116 - DNA, 16 bp, Artificial Sequence
  synthetic [barcode part1]
gtcgcacttgaatacg

SEQ ID NO: 40117 - DNA, 16 bp, Artificial Sequence
  synthetic [barcode part1]
tcgtctcttaggtgcg

SEQ ID NO: 40118 - DNA, 16 bp, Artificial Sequence
  synthetic [barcode part1]
ttaatactgcgcggtg

SEQ ID NO: 40119 - DNA, 16 bp, Artificial Sequence
  synthetic [barcode part1]
tcacttgcctatccgt

SEQ ID NO: 40120 - DNA, 16 bp, Artificial Sequence
  synthetic [barcode part1]
cagtaatcgcggaggt

SEQ ID NO: 40121 - DNA, 16 bp, Artificial Sequence
  synthetic [barcode part1]
aagaggcctcaacttc

SEQ ID NO: 40122 - DNA, 16 bp, Artificial Sequence
  synthetic [barcode part1]
tgaccagatcaaccgt

SEQ ID NO: 40123 - DNA, 16 bp, Artificial Sequence
  synthetic [barcode part1]
acaacacctccagaac

SEQ ID NO: 40124 - DNA, 16 bp, Artificial Sequence
  synthetic [barcode part1]
tatcggtagaggaccg

SEQ ID NO: 40125 - DNA, 16 bp, Artificial Sequence
  synthetic [barcode part1]
cggtagttaacgacct

SEQ ID NO: 40126 - DNA, 16 bp, Artificial Sequence
  synthetic [barcode part1]
cactcctcggtagttg

SEQ ID NO: 40127 - DNA, 16 bp, Artificial Sequence
  synthetic [barcode part1]
cgcctactagacaagt

SEQ ID NO: 40128 - DNA, 16 bp, Artificial Sequence
  synthetic [barcode part1]
tcaagtggaacctacc

SEQ ID NO: 40129 - DNA, 16 bp, Artificial Sequence
  synthetic [barcode part1]
aggtgtgaaccaccag

SEQ ID NO: 40130 - DNA, 16 bp, Artificial Sequence
  synthetic [barcode part1]
acgttcagtgaatccg

SEQ ID NO: 40131 - DNA, 16 bp, Artificial Sequence
  synthetic [barcode part1]
cagtacaaggaaccgc

SEQ ID NO: 40132 - DNA, 16 bp, Artificial Sequence
  synthetic [barcode part1]
acacagtagaactgac

SEQ ID NO: 40133 - DNA, 16 bp, Artificial Sequence
  synthetic [barcode part1]
gacaaccaagacgcgt

SEQ ID NO: 40134 - DNA, 16 bp, Artificial Sequence
  synthetic [barcode part1]
gttcggactgttccgt

SEQ ID NO: 40135 - DNA, 16 bp, Artificial Sequence
  synthetic [barcode part1]
tgtggcaggtgagtgt

SEQ ID NO: 40136 - DNA, 16 bp, Artificial Sequence
  synthetic [barcode part1]
tattccaactccgtcc

SEQ ID NO: 40137 - DNA, 16 bp, Artificial Sequence
  synthetic [barcode part1]
gacttcagtagacaag

SEQ ID NO: 40138 - DNA, 16 bp, Artificial Sequence
  synthetic [barcode part1]
agagattcgactgtag

SEQ ID NO: 40139 - DNA, 16 bp, Artificial Sequence
  synthetic [barcode part1]
gttgtgttgacagaag

SEQ ID NO: 40140 - DNA, 16 bp, Artificial Sequence
  synthetic [barcode part1]
cagacaggacaagtag

SEQ ID NO: 40141 - DNA, 16 bp, Artificial Sequence
  synthetic [barcode part1]
tgattgccggagagtg

SEQ ID NO: 40142 - DNA, 16 bp, Artificial Sequence
  synthetic [barcode part1]
ttctgtggactatcgt

SEQ ID NO: 40143 - DNA, 16 bp, Artificial Sequence
  synthetic [barcode part1]
acgacgcgttaactac

SEQ ID NO: 40144 - DNA, 16 bp, Artificial Sequence
  synthetic [barcode part1]
gcgaagtaccttatcg

SEQ ID NO: 40145 - DNA, 16 bp, Artificial Sequence
  synthetic [barcode part1]
tgaacgtgtgtgactc

SEQ ID NO: 40146 - DNA, 16 bp, Artificial Sequence
  synthetic [barcode part1]
acgtcaacttctaacc

SEQ ID NO: 40147 - DNA, 16 bp, Artificial Sequence
  synthetic [barcode part1]
cactgaactacacttc

SEQ ID NO: 40148 - DNA, 16 bp, Artificial Sequence
  synthetic [barcode part1]
gttgactgtgttgcag

SEQ ID NO: 40149 - DNA, 16 bp, Artificial Sequence
  synthetic [barcode part1]
taagtgtgtacggcct

SEQ ID NO: 40150 - DNA, 16 bp, Artificial Sequence
  synthetic [barcode part1]
agactaccgttcttac

SEQ ID NO: 40151 - DNA, 16 bp, Artificial Sequence
  synthetic [barcode part1]
gagacctgaatctcgt

SEQ ID NO: 40152 - DNA, 16 bp, Artificial Sequence
  synthetic [barcode part1]
tactgagagtggttcc

SEQ ID NO: 40153 - DNA, 16 bp, Artificial Sequence
  synthetic [barcode part1]
cgtgataactccgaac

SEQ ID NO: 40154 - DNA, 16 bp, Artificial Sequence
  synthetic [barcode part1]
gtacgtgtcggaactt

SEQ ID NO: 40155 - DNA, 16 bp, Artificial Sequence
  synthetic [barcode part1]
ttcactatcctcgacc

SEQ ID NO: 40156 - DNA, 16 bp, Artificial Sequence
  synthetic [barcode part1]
atcgcgccgattcttg

SEQ ID NO: 40157 - DNA, 16 bp, Artificial Sequence
  synthetic [barcode part1]
gaggatactgtcaagt

SEQ ID NO: 40158 - DNA, 16 bp, Artificial Sequence
  synthetic [barcode part1]
gaacgttactcgtgac

SEQ ID NO: 40159 - DNA, 16 bp, Artificial Sequence
  synthetic [barcode part1]
ttacgttcaggaacgc

SEQ ID NO: 40160 - DNA, 16 bp, Artificial Sequence
  synthetic [barcode part1]
actcaaccagtggttg

SEQ ID NO: 40161 - DNA, 16 bp, Artificial Sequence
  synthetic [barcode part1]
tgactagagtcttggc

SEQ ID NO: 40162 - DNA, 16 bp, Artificial Sequence
  synthetic [barcode part1]
tgtgttccacttccgt

SEQ ID NO: 40163 - DNA, 16 bp, Artificial Sequence
  synthetic [barcode part1]
cgtacgcaatcaatcg

SEQ ID NO: 40164 - DNA, 16 bp, Artificial Sequence
  synthetic [barcode part1]
caccgaactcgtgtct

SEQ ID NO: 40165 - DNA, 16 bp, Artificial Sequence
  synthetic [barcode part1]
gacagaaccaatacgt

SEQ ID NO: 40166 - DNA, 16 bp, Artificial Sequence
  synthetic [barcode part1]
actagtcaaccggttg

SEQ ID NO: 40167 - DNA, 16 bp, Artificial Sequence
  synthetic [barcode part1]
tgatcgtcctacagag

SEQ ID NO: 40168 - DNA, 16 bp, Artificial Sequence
  synthetic [barcode part1]
tgttgcactgaccaag

SEQ ID NO: 40169 - DNA, 16 bp, Artificial Sequence
  synthetic [barcode part1]
aagagtaccgccgaac

SEQ ID NO: 40170 - DNA, 16 bp, Artificial Sequence
  synthetic [barcode part1]
tccgtatagaggcact

SEQ ID NO: 40171 - DNA, 16 bp, Artificial Sequence
  synthetic [barcode part1]
aagtagtggtcgcgtg

SEQ ID NO: 40172 - DNA, 16 bp, Artificial Sequence
  synthetic [barcode part1]
ttgttactatccggac

SEQ ID NO: 40173 - DNA, 16 bp, Artificial Sequence
  synthetic [barcode part1]
tccacctcgagattcg

SEQ ID NO: 40174 - DNA, 16 bp, Artificial Sequence
  synthetic [barcode part1]
tcactacactctgcct

SEQ ID NO: 40175 - DNA, 16 bp, Artificial Sequence
  synthetic [barcode part1]
gtctccactcaacgac

SEQ ID NO: 40176 - DNA, 16 bp, Artificial Sequence
  synthetic [barcode part1]
agtcggtgaagtctct

SEQ ID NO: 40177 - DNA, 16 bp, Artificial Sequence
  synthetic [barcode part1]
caagataaggcacttg

SEQ ID NO: 40178 - DNA, 16 bp, Artificial Sequence
  synthetic [barcode part1]
cctcactgttctatcg

SEQ ID NO: 40179 - DNA, 16 bp, Artificial Sequence
  synthetic [barcode part1]
tctccgaacgcgttac

SEQ ID NO: 40180 - DNA, 16 bp, Artificial Sequence
  synthetic [barcode part1]
tacctactccacctgt

SEQ ID NO: 40181 - DNA, 16 bp, Artificial Sequence
  synthetic [barcode part1]
gattcggaccgttagt

SEQ ID NO: 40182 - DNA, 16 bp, Artificial Sequence
  synthetic [barcode part1]
ttacgttctcaacgac

SEQ ID NO: 40183 - DNA, 16 bp, Artificial Sequence
  synthetic [barcode part1]
tcgacctagattggac

SEQ ID NO: 40184 - DNA, 16 bp, Artificial Sequence
  synthetic [barcode part1]
gtataccacaactgcg

SEQ ID NO: 40185 - DNA, 16 bp, Artificial Sequence
  synthetic [barcode part1]
tggtatcgtaggcgag

SEQ ID NO: 40186 - DNA, 16 bp, Artificial Sequence
  synthetic [barcode part1]
taccgcgtaataccag

SEQ ID NO: 40187 - DNA, 16 bp, Artificial Sequence
  synthetic [barcode part1]
tccgactcagttgcac

SEQ ID NO: 40188 - DNA, 16 bp, Artificial Sequence
  synthetic [barcode part1]
agtaacacggatactg

SEQ ID NO: 40189 - DNA, 16 bp, Artificial Sequence
  synthetic [barcode part1]
tgtgtcttcgtgtcct

SEQ ID NO: 40190 - DNA, 16 bp, Artificial Sequence
  synthetic [barcode part1]
ccttaagtccaaggtg

SEQ ID NO: 40191 - DNA, 16 bp, Artificial Sequence
  synthetic [barcode part1]
gttgagtccgtacctc

SEQ ID NO: 40192 - DNA, 16 bp, Artificial Sequence
  synthetic [barcode part1]
gacacttgagtactcg

SEQ ID NO: 40193 - DNA, 16 bp, Artificial Sequence
  synthetic [barcode part1]
ttcgcgtatcaagttc

SEQ ID NO: 40194 - DNA, 16 bp, Artificial Sequence
  synthetic [barcode part1]
atcgcgatcacttact

SEQ ID NO: 40195 - DNA, 16 bp, Artificial Sequence
  synthetic [barcode part1]
gacttgaatacctctc

SEQ ID NO: 40196 - DNA, 16 bp, Artificial Sequence
  synthetic [barcode part1]
tgcagatagtaggatc

SEQ ID NO: 40197 - DNA, 16 bp, Artificial Sequence
  synthetic [barcode part1]
gacgagtagtgtcacg

SEQ ID NO: 40198 - DNA, 16 bp, Artificial Sequence
  synthetic [barcode part1]
ttcacaggcaatagag

SEQ ID NO: 40199 - DNA, 16 bp, Artificial Sequence
  synthetic [barcode part1]
agatctcgcactacag

SEQ ID NO: 40200 - DNA, 16 bp, Artificial Sequence
  synthetic [barcode part1]
ccagtggatagaggtc

SEQ ID NO: 40201 - DNA, 16 bp, Artificial Sequence
  synthetic [barcode part1]
cctaaccagtcaagac

SEQ ID NO: 40202 - DNA, 16 bp, Artificial Sequence
  synthetic [barcode part1]
ttctggacaccacaag

SEQ ID NO: 40203 - DNA, 16 bp, Artificial Sequence
  synthetic [barcode part1]
ttcggataacgcgttg

SEQ ID NO: 40204 - DNA, 16 bp, Artificial Sequence
  synthetic [barcode part1]
gaagacgcggactatc

SEQ ID NO: 40205 - DNA, 16 bp, Artificial Sequence
  synthetic [barcode part1]
acgttccgtcgtcaac

SEQ ID NO: 40206 - DNA, 16 bp, Artificial Sequence
  synthetic [barcode part1]
atcgtaggcggtattc

SEQ ID NO: 40207 - DNA, 16 bp, Artificial Sequence
  synthetic [barcode part1]
actgacagacacgttc

SEQ ID NO: 40208 - DNA, 16 bp, Artificial Sequence
  synthetic [barcode part1]
attctgtacctgagtc

SEQ ID NO: 40209 - DNA, 16 bp, Artificial Sequence
  synthetic [barcode part1]
tatacgcaactgaccg

SEQ ID NO: 40210 - DNA, 16 bp, Artificial Sequence
  synthetic [barcode part1]
cagttccggaactaac

SEQ ID NO: 40211 - DNA, 16 bp, Artificial Sequence
  synthetic [barcode part1]
gttgataggtgtgcct

SEQ ID NO: 40212 - DNA, 16 bp, Artificial Sequence
  synthetic [barcode part1]
taccggagacgtgagt

SEQ ID NO: 40213 - DNA, 16 bp, Artificial Sequence
  synthetic [barcode part1]
gagtactgacacttgc

SEQ ID NO: 40214 - DNA, 16 bp, Artificial Sequence
  synthetic [barcode part1]
gtctcaagtcgatcag

SEQ ID NO: 40215 - DNA, 16 bp, Artificial Sequence
  synthetic [barcode part1]
tgcacgaccactacct

SEQ ID NO: 40216 - DNA, 16 bp, Artificial Sequence
  synthetic [barcode part1]
gccaagtgcgaggatt

SEQ ID NO: 40217 - DNA, 16 bp, Artificial Sequence
  synthetic [barcode part1]
tagtcctcggtgcact

SEQ ID NO: 40218 - DNA, 16 bp, Artificial Sequence
  synthetic [barcode part1]
gtgaattggttcgcgt

SEQ ID NO: 40219 - DNA, 16 bp, Artificial Sequence
  synthetic [barcode part1]
tgccttaaggtggtgt

SEQ ID NO: 40220 - DNA, 16 bp, Artificial Sequence
  synthetic [barcode part1]
cctgttggtacctgac

SEQ ID NO: 40221 - DNA, 16 bp, Artificial Sequence
  synthetic [barcode part1]
gcgacggtagatctag

SEQ ID NO: 40222 - DNA, 16 bp, Artificial Sequence
  synthetic [barcode part1]
atcttatcggatccgt

SEQ ID NO: 40223 - DNA, 16 bp, Artificial Sequence
  synthetic [barcode part1]
acgacgttacgacgtt

SEQ ID NO: 40224 - DNA, 16 bp, Artificial Sequence
  synthetic [barcode part1]
gtagtgtgaggagaac

SEQ ID NO: 40225 - DNA, 16 bp, Artificial Sequence
  synthetic [barcode part1]
tgccttgtaagtgttc

SEQ ID NO: 40226 - DNA, 16 bp, Artificial Sequence
  synthetic [barcode part1]
tcgatacagaggattg

SEQ ID NO: 40227 - DNA, 16 bp, Artificial Sequence
  synthetic [barcode part1]
tgtctgtggtgccgtt

SEQ ID NO: 40228 - DNA, 16 bp, Artificial Sequence
  synthetic [barcode part1]
tgatcgacgtagtgtc

SEQ ID NO: 40229 - DNA, 16 bp, Artificial Sequence
  synthetic [barcode part1]
tctccgacgtgattgc

SEQ ID NO: 40230 - DNA, 16 bp, Artificial Sequence
  synthetic [barcode part1]
aggagatcggatccgt

SEQ ID NO: 40231 - DNA, 16 bp, Artificial Sequence
  synthetic [barcode part1]
acaacggtcacgtgag

SEQ ID NO: 40232 - DNA, 16 bp, Artificial Sequence
  synthetic [barcode part1]
gaacttgcactctatc

SEQ ID NO: 40233 - DNA, 16 bp, Artificial Sequence
  synthetic [barcode part1]
tagtgaacgttgcctg

SEQ ID NO: 40234 - DNA, 16 bp, Artificial Sequence
  synthetic [barcode part1]
actcgaatatcgtctc

SEQ ID NO: 40235 - DNA, 16 bp, Artificial Sequence
  synthetic [barcode part1]
agatcgtgtaagaacc

SEQ ID NO: 40236 - DNA, 16 bp, Artificial Sequence
  synthetic [barcode part1]
gttcgtaggttgtacg

SEQ ID NO: 40237 - DNA, 16 bp, Artificial Sequence
  synthetic [barcode part1]
acaccgcaagtcttag

SEQ ID NO: 40238 - DNA, 16 bp, Artificial Sequence
  synthetic [barcode part1]
tgtggcgattcactcc

SEQ ID NO: 40239 - DNA, 16 bp, Artificial Sequence
  synthetic [barcode part1]
aatagtggcggactcg

SEQ ID NO: 40240 - DNA, 16 bp, Artificial Sequence
  synthetic [barcode part1]
tgttctatactcaggc

SEQ ID NO: 40241 - DNA, 16 bp, Artificial Sequence
  synthetic [barcode part1]
tgaagagtcggtctct

SEQ ID NO: 40242 - DNA, 16 bp, Artificial Sequence
  synthetic [barcode part1]
ttactgtctgtctcgc

SEQ ID NO: 40243 - DNA, 16 bp, Artificial Sequence
  synthetic [barcode part1]
aggaggcaagtgcctt

SEQ ID NO: 40244 - DNA, 16 bp, Artificial Sequence
  synthetic [barcode part1]
gtaatcacacgcggtt

SEQ ID NO: 40245 - DNA, 16 bp, Artificial Sequence
  synthetic [barcode part1]
aaggtctcttgttcac

SEQ ID NO: 40246 - DNA, 16 bp, Artificial Sequence
  synthetic [barcode part1]
ttacttgttgcagtgc

SEQ ID NO: 40247 - DNA, 16 bp, Artificial Sequence
  synthetic [barcode part1]
tagttctcgcgcgatc

SEQ ID NO: 40248 - DNA, 16 bp, Artificial Sequence
  synthetic [barcode part1]
tactccgtactactcc

SEQ ID NO: 40249 - DNA, 16 bp, Artificial Sequence
  synthetic [barcode part1]
gtagtaaggacgcctg

SEQ ID NO: 40250 - DNA, 16 bp, Artificial Sequence
  synthetic [barcode part1]
ttacctgtccgaagtt

SEQ ID NO: 40251 - DNA, 16 bp, Artificial Sequence
  synthetic [barcode part1]
accttacgaacactct

SEQ ID NO: 40252 - DNA, 16 bp, Artificial Sequence
  synthetic [barcode part1]
caggtcagaggacgtt

SEQ ID NO: 40253 - DNA, 16 bp, Artificial Sequence
  synthetic [barcode part1]
gtctcgttaccgacac

SEQ ID NO: 40254 - DNA, 16 bp, Artificial Sequence
  synthetic [barcode part1]
ccttgactatattggc

SEQ ID NO: 40255 - DNA, 16 bp, Artificial Sequence
  synthetic [barcode part1]
ttactcaacggcgtcc

SEQ ID NO: 40256 - DNA, 16 bp, Artificial Sequence
  synthetic [barcode part1]
ttctgattgtaccgac

SEQ ID NO: 40257 - DNA, 16 bp, Artificial Sequence
  synthetic [barcode part1]
tatcaccacgatcgtt

SEQ ID NO: 40258 - DNA, 16 bp, Artificial Sequence
  synthetic [barcode part1]
tgagtcgtctccacgt

SEQ ID NO: 40259 - DNA, 16 bp, Artificial Sequence
  synthetic [barcode part1]
ttcctatccgttgaag

SEQ ID NO: 40260 - DNA, 16 bp, Artificial Sequence
  synthetic [barcode part1]
acgacgttggtatcgt

SEQ ID NO: 40261 - DNA, 16 bp, Artificial Sequence
  synthetic [barcode part1]
ccttacacgcagaagt

SEQ ID NO: 40262 - DNA, 16 bp, Artificial Sequence
  synthetic [barcode part1]
cgactataggtatccg

SEQ ID NO: 40263 - DNA, 16 bp, Artificial Sequence
  synthetic [barcode part1]
ttcggagtcagttggt

SEQ ID NO: 40264 - DNA, 16 bp, Artificial Sequence
  synthetic [barcode part1]
actcagagaacaacac

SEQ ID NO: 40265 - DNA, 16 bp, Artificial Sequence
  synthetic [barcode part1]
cgaatcacgacaatcc

SEQ ID NO: 40266 - DNA, 16 bp, Artificial Sequence
  synthetic [barcode part1]
cgcacacagaattctg

SEQ ID NO: 40267 - DNA, 16 bp, Artificial Sequence
  synthetic [barcode part1]
ttctgtagtgcaggac

SEQ ID NO: 40268 - DNA, 16 bp, Artificial Sequence
  synthetic [barcode part1]
tgtagacggtattcgc

SEQ ID NO: 40269 - DNA, 16 bp, Artificial Sequence
  synthetic [barcode part1]
gtagatcactgagaac

SEQ ID NO: 40270 - DNA, 16 bp, Artificial Sequence
  synthetic [barcode part1]
tgcggtgtagaacttc

SEQ ID NO: 40271 - DNA, 16 bp, Artificial Sequence
  synthetic [barcode part1]
gcgcggttcctaactt

SEQ ID NO: 40272 - DNA, 16 bp, Artificial Sequence
  synthetic [barcode part1]
aatcttcgcacctaac

SEQ ID NO: 40273 - DNA, 16 bp, Artificial Sequence
  synthetic [barcode part1]
ccggcgaatccttact

SEQ ID NO: 40274 - DNA, 16 bp, Artificial Sequence
  synthetic [barcode part1]
atcttcagtcctcgtc

SEQ ID NO: 40275 - DNA, 16 bp, Artificial Sequence
  synthetic [barcode part1]
cgacaatagagatacc

SEQ ID NO: 40276 - DNA, 16 bp, Artificial Sequence
  synthetic [barcode part1]
cgtactctctggtgac

SEQ ID NO: 40277 - DNA, 16 bp, Artificial Sequence
  synthetic [barcode part1]
cagtgcgtgattcctc

SEQ ID NO: 40278 - DNA, 16 bp, Artificial Sequence
  synthetic [barcode part1]
cgcaagaaccaggttg

SEQ ID NO: 40279 - DNA, 16 bp, Artificial Sequence
  synthetic [barcode part1]
ccgcgagttattactt

SEQ ID NO: 40280 - DNA, 16 bp, Artificial Sequence
  synthetic [barcode part1]
tcgaactgaccgttag

SEQ ID NO: 40281 - DNA, 16 bp, Artificial Sequence
  synthetic [barcode part1]
agacctggtccttcgt

SEQ ID NO: 40282 - DNA, 16 bp, Artificial Sequence
  synthetic [barcode part1]
tgcaacgacttactct

SEQ ID NO: 40283 - DNA, 16 bp, Artificial Sequence
  synthetic [barcode part1]
gagataggacggaact

SEQ ID NO: 40284 - DNA, 16 bp, Artificial Sequence
  synthetic [barcode part1]
cctaattaccaacgtc

SEQ ID NO: 40285 - DNA, 16 bp, Artificial Sequence
  synthetic [barcode part1]
gaataagatccgcctc

SEQ ID NO: 40286 - DNA, 16 bp, Artificial Sequence
  synthetic [barcode part1]
acgatctcctgacaag

SEQ ID NO: 40287 - DNA, 16 bp, Artificial Sequence
  synthetic [barcode part1]
tcggtctctcacgaac

SEQ ID NO: 40288 - DNA, 16 bp, Artificial Sequence
  synthetic [barcode part1]
cagattaagaacgcgt

SEQ ID NO: 40289 - DNA, 16 bp, Artificial Sequence
  synthetic [barcode part1]
tcagtccacttagatc

SEQ ID NO: 40290 - DNA, 16 bp, Artificial Sequence
  synthetic [barcode part1]
gaggatccaacacacg

SEQ ID NO: 40291 - DNA, 16 bp, Artificial Sequence
  synthetic [barcode part1]
gaacggtccgaatacg

SEQ ID NO: 40292 - DNA, 16 bp, Artificial Sequence
  synthetic [barcode part1]
ccttcctcaatcggtt

SEQ ID NO: 40293 - DNA, 16 bp, Artificial Sequence
  synthetic [barcode part1]
cgccaagtgttctcac

SEQ ID NO: 40294 - DNA, 16 bp, Artificial Sequence
  synthetic [barcode part1]
actgatacggatccgt

SEQ ID NO: 40295 - DNA, 16 bp, Artificial Sequence
  synthetic [barcode part1]
cgatcagaacctcagt

SEQ ID NO: 40296 - DNA, 16 bp, Artificial Sequence
  synthetic [barcode part1]
tatacctctactaggc

SEQ ID NO: 40297 - DNA, 16 bp, Artificial Sequence
  synthetic [barcode part1]
tgtacgattcaactcc

SEQ ID NO: 40298 - DNA, 16 bp, Artificial Sequence
  synthetic [barcode part1]
accaggtgacacaggt

SEQ ID NO: 40299 - DNA, 16 bp, Artificial Sequence
  synthetic [barcode part1]
cacagagaaggatacg

SEQ ID NO: 40300 - DNA, 16 bp, Artificial Sequence
  synthetic [barcode part1]
gtaacgtgatcttggc

SEQ ID NO: 40301 - DNA, 16 bp, Artificial Sequence
  synthetic [barcode part1]
tccgtgtgatcgttgc

SEQ ID NO: 40302 - DNA, 16 bp, Artificial Sequence
  synthetic [barcode part1]
tgcaacgtgcctgtct

SEQ ID NO: 40303 - DNA, 16 bp, Artificial Sequence
  synthetic [barcode part1]
gttaggccttgacagt

SEQ ID NO: 40304 - DNA, 16 bp, Artificial Sequence
  synthetic [barcode part1]
tgccttaacagactct

SEQ ID NO: 40305 - DNA, 16 bp, Artificial Sequence
  synthetic [barcode part1]
atagacaaggtaggcg

SEQ ID NO: 40306 - DNA, 16 bp, Artificial Sequence
  synthetic [barcode part1]
gcagaaggttaccgac

SEQ ID NO: 40307 - DNA, 16 bp, Artificial Sequence
  synthetic [barcode part1]
tcctacgaccaggttc

SEQ ID NO: 40308 - DNA, 16 bp, Artificial Sequence
  synthetic [barcode part1]
cgtattgaggatcaag

SEQ ID NO: 40309 - DNA, 16 bp, Artificial Sequence
  synthetic [barcode part1]
actacttgaacggtgc

SEQ ID NO: 40310 - DNA, 16 bp, Artificial Sequence
  synthetic [barcode part1]
ttcgcacaatcactac

SEQ ID NO: 40311 - DNA, 16 bp, Artificial Sequence
  synthetic [barcode part1]
acagagatctcgcact

SEQ ID NO: 40312 - DNA, 16 bp, Artificial Sequence
  synthetic [barcode part1]
atctcagagtcggttg

SEQ ID NO: 40313 - DNA, 16 bp, Artificial Sequence
  synthetic [barcode part1]
acgtatcacgattgcg

SEQ ID NO: 40314 - DNA, 16 bp, Artificial Sequence
  synthetic [barcode part1]
gatactcttcggtccg

SEQ ID NO: 40315 - DNA, 16 bp, Artificial Sequence
  synthetic [barcode part1]
ccagataagatccacc

SEQ ID NO: 40316 - DNA, 16 bp, Artificial Sequence
  synthetic [barcode part1]
actcgagaacagaact

SEQ ID NO: 40317 - DNA, 16 bp, Artificial Sequence
  synthetic [barcode part1]
gttgatactactgcct

SEQ ID NO: 40318 - DNA, 16 bp, Artificial Sequence
  synthetic [barcode part1]
gaacaccgtgagtctt

SEQ ID NO: 40319 - DNA, 16 bp, Artificial Sequence
  synthetic [barcode part1]
gattgtaaggaggtct

SEQ ID NO: 40320 - DNA, 16 bp, Artificial Sequence
  synthetic [barcode part1]
gatcggacctaattcg

SEQ ID NO: 40321 - DNA, 16 bp, Artificial Sequence
  synthetic [barcode part1]
tcgcgttagtaattcc

SEQ ID NO: 40322 - DNA, 16 bp, Artificial Sequence
  synthetic [barcode part1]
cctcgtgccgatagtt

SEQ ID NO: 40323 - DNA, 16 bp, Artificial Sequence
  synthetic [barcode part1]
tgatcggaatcgacct

SEQ ID NO: 40324 - DNA, 16 bp, Artificial Sequence
  synthetic [barcode part1]
atagtcgtcctgattc

SEQ ID NO: 40325 - DNA, 16 bp, Artificial Sequence
  synthetic [barcode part1]
attctggtgattggcg

SEQ ID NO: 40326 - DNA, 16 bp, Artificial Sequence
  synthetic [barcode part1]
tcttgcaggagtgtgt

SEQ ID NO: 40327 - DNA, 16 bp, Artificial Sequence
  synthetic [barcode part1]
cacaatcttaggcgtg

SEQ ID NO: 40328 - DNA, 16 bp, Artificial Sequence
  synthetic [barcode part1]
tgtactggttggtgtg

SEQ ID NO: 40329 - DNA, 16 bp, Artificial Sequence
  synthetic [barcode part1]
tgacgtacagttcttc

SEQ ID NO: 40330 - DNA, 16 bp, Artificial Sequence
  synthetic [barcode part1]
actgaggtatagtcag

SEQ ID NO: 40331 - DNA, 16 bp, Artificial Sequence
  synthetic [barcode part1]
tataatctcctcggtg

SEQ ID NO: 40332 - DNA, 16 bp, Artificial Sequence
  synthetic [barcode part1]
tcctgtctaagtactg

SEQ ID NO: 40333 - DNA, 16 bp, Artificial Sequence
  synthetic [barcode part1]
tgtgtacactggtcag

SEQ ID NO: 40334 - DNA, 16 bp, Artificial Sequence
  synthetic [barcode part1]
gatcttctgtagacct

SEQ ID NO: 40335 - DNA, 16 bp, Artificial Sequence
  synthetic [barcode part1]
tctgaacgagtcggag

SEQ ID NO: 40336 - DNA, 16 bp, Artificial Sequence
  synthetic [barcode part1]
tggtgaggagtaacag

SEQ ID NO: 40337 - DNA, 16 bp, Artificial Sequence
  synthetic [barcode part1]
accactacgtgaggag

SEQ ID NO: 40338 - DNA, 16 bp, Artificial Sequence
  synthetic [barcode part1]
tgtctaccaggtgagt

SEQ ID NO: 40339 - DNA, 16 bp, Artificial Sequence
  synthetic [barcode part1]
gatactcttgccaccg

SEQ ID NO: 40340 - DNA, 16 bp, Artificial Sequence
  synthetic [barcode part1]
gtatcgaacgtggttc

SEQ ID NO: 40341 - DNA, 16 bp, Artificial Sequence
  synthetic [barcode part1]
cgatacaagaggttac

SEQ ID NO: 40342 - DNA, 16 bp, Artificial Sequence
  synthetic [barcode part1]
agaagtacttgacgac

SEQ ID NO: 40343 - DNA, 16 bp, Artificial Sequence
  synthetic [barcode part1]
cgtcggtgattcttcg

SEQ ID NO: 40344 - DNA, 16 bp, Artificial Sequence
  synthetic [barcode part1]
gtctaacgcacaggag

SEQ ID NO: 40345 - DNA, 16 bp, Artificial Sequence
  synthetic [barcode part1]
gcaagtggtcctgaag

SEQ ID NO: 40346 - DNA, 16 bp, Artificial Sequence
  synthetic [barcode part1]
taccagtgtacaccag

SEQ ID NO: 40347 - DNA, 16 bp, Artificial Sequence
  synthetic [barcode part1]
ccttaattgcaccggc

SEQ ID NO: 40348 - DNA, 16 bp, Artificial Sequence
  synthetic [barcode part1]
atcgccgacacagaag

SEQ ID NO: 40349 - DNA, 16 bp, Artificial Sequence
  synthetic [barcode part1]
aggtattggacagtgt

SEQ ID NO: 40350 - DNA, 16 bp, Artificial Sequence
  synthetic [barcode part1]
aacctagttcttgtgc

SEQ ID NO: 40351 - DNA, 16 bp, Artificial Sequence
  synthetic [barcode part1]
ccgtgtggactagaag

SEQ ID NO: 40352 - DNA, 16 bp, Artificial Sequence
  synthetic [barcode part1]
atattcctgcgtcctc

SEQ ID NO: 40353 - DNA, 16 bp, Artificial Sequence
  synthetic [barcode part1]
agttcaccgttatctg

SEQ ID NO: 40354 - DNA, 16 bp, Artificial Sequence
  synthetic [barcode part1]
caaggttaaccgatcc

SEQ ID NO: 40355 - DNA, 16 bp, Artificial Sequence
  synthetic [barcode part1]
ccagtctatccaggtc

SEQ ID NO: 40356 - DNA, 16 bp, Artificial Sequence
  synthetic [barcode part1]
tggtgtaaggaaccgc

SEQ ID NO: 40357 - DNA, 16 bp, Artificial Sequence
  synthetic [barcode part1]
cgaacttcaagtaccg

SEQ ID NO: 40358 - DNA, 16 bp, Artificial Sequence
  synthetic [barcode part1]
tgttctggtaagtcct

SEQ ID NO: 40359 - DNA, 16 bp, Artificial Sequence
  synthetic [barcode part1]
caatcgtcctacgaag

SEQ ID NO: 40360 - DNA, 16 bp, Artificial Sequence
  synthetic [barcode part1]
aggatcttatcacggc

SEQ ID NO: 40361 - DNA, 16 bp, Artificial Sequence
  synthetic [barcode part1]
agattcgtgaactcgc

SEQ ID NO: 40362 - DNA, 16 bp, Artificial Sequence
  synthetic [barcode part1]
tgtgtcaagtcctccg

SEQ ID NO: 40363 - DNA, 16 bp, Artificial Sequence
  synthetic [barcode part1]
agataccactctatcc

SEQ ID NO: 40364 - DNA, 16 bp, Artificial Sequence
  synthetic [barcode part1]
ttctgcagtgtggagt

SEQ ID NO: 40365 - DNA, 16 bp, Artificial Sequence
  synthetic [barcode part1]
acgtcaattagtgcgc

SEQ ID NO: 40366 - DNA, 16 bp, Artificial Sequence
  synthetic [barcode part1]
agataactcggatacg

SEQ ID NO: 40367 - DNA, 16 bp, Artificial Sequence
  synthetic [barcode part1]
tacacagtggagaatc

SEQ ID NO: 40368 - DNA, 16 bp, Artificial Sequence
  synthetic [barcode part1]
cggaatcaatcggtct

SEQ ID NO: 40369 - DNA, 16 bp, Artificial Sequence
  synthetic [barcode part1]
cacagacagactcgtt

SEQ ID NO: 40370 - DNA, 16 bp, Artificial Sequence
  synthetic [barcode part1]
tacaggcagtagagtt

SEQ ID NO: 40371 - DNA, 16 bp, Artificial Sequence
  synthetic [barcode part1]
gtccagaatctcgcct

SEQ ID NO: 40372 - DNA, 16 bp, Artificial Sequence
  synthetic [barcode part1]
tggaacttcaaggtcc

SEQ ID NO: 40373 - DNA, 16 bp, Artificial Sequence
  synthetic [barcode part1]
accgaatcgttgagtc

SEQ ID NO: 40374 - DNA, 16 bp, Artificial Sequence
  synthetic [barcode part1]
gcgtattctgtgtgag

SEQ ID NO: 40375 - DNA, 16 bp, Artificial Sequence
  synthetic [barcode part1]
aatcagatactccgcg

SEQ ID NO: 40376 - DNA, 16 bp, Artificial Sequence
  synthetic [barcode part1]
aggaatagtccgacgc

SEQ ID NO: 40377 - DNA, 16 bp, Artificial Sequence
  synthetic [barcode part1]
ccgcagaccactattc

SEQ ID NO: 40378 - DNA, 16 bp, Artificial Sequence
  synthetic [barcode part1]
tggagttatacgcacc

SEQ ID NO: 40379 - DNA, 16 bp, Artificial Sequence
  synthetic [barcode part1]
cgtacctaacaacttc

SEQ ID NO: 40380 - DNA, 16 bp, Artificial Sequence
  synthetic [barcode part1]
tcaacagagaccactc

SEQ ID NO: 40381 - DNA, 16 bp, Artificial Sequence
  synthetic [barcode part1]
cagacttcttactgtg

SEQ ID NO: 40382 - DNA, 16 bp, Artificial Sequence
  synthetic [barcode part1]
attcggtaaggcgcag

SEQ ID NO: 40383 - DNA, 16 bp, Artificial Sequence
  synthetic [barcode part1]
ttgtaggcaagaagtc

SEQ ID NO: 40384 - DNA, 16 bp, Artificial Sequence
  synthetic [barcode part1]
ccaagtagtctcgtcc

SEQ ID NO: 40385 - DNA, 16 bp, Artificial Sequence
  synthetic [barcode part1]
gattcttaaccgtgtc

SEQ ID NO: 40386 - DNA, 16 bp, Artificial Sequence
  synthetic [barcode part1]
tccgtacctagattac

SEQ ID NO: 40387 - DNA, 16 bp, Artificial Sequence
  synthetic [barcode part1]
tccgtaaggcaagacg

SEQ ID NO: 40388 - DNA, 16 bp, Artificial Sequence
  synthetic [barcode part1]
actcgagaagtccact

SEQ ID NO: 40389 - DNA, 16 bp, Artificial Sequence
  synthetic [barcode part1]
tcacctgttgttcgtc

SEQ ID NO: 40390 - DNA, 16 bp, Artificial Sequence
  synthetic [barcode part1]
tccttggactgtgtgc

SEQ ID NO: 40391 - DNA, 16 bp, Artificial Sequence
  synthetic [barcode part1]
cgcggactagaacagt

SEQ ID NO: 40392 - DNA, 16 bp, Artificial Sequence
  synthetic [barcode part1]
tactactcaagtctgc

SEQ ID NO: 40393 - DNA, 16 bp, Artificial Sequence
  synthetic [barcode part1]
gcaacgaacttcctag

SEQ ID NO: 40394 - DNA, 16 bp, Artificial Sequence
  synthetic [barcode part1]
gttgacgagtacgtct

SEQ ID NO: 40395 - DNA, 16 bp, Artificial Sequence
  synthetic [barcode part1]
actcctagacgcaagt

SEQ ID NO: 40396 - DNA, 16 bp, Artificial Sequence
  synthetic [barcode part1]
tgatcttgccgacacc

SEQ ID NO: 40397 - DNA, 16 bp, Artificial Sequence
  synthetic [barcode part1]
cactgtctattccgtc

SEQ ID NO: 40398 - DNA, 16 bp, Artificial Sequence
  synthetic [barcode part1]
gcagtgcgattgattc

SEQ ID NO: 40399 - DNA, 16 bp, Artificial Sequence
  synthetic [barcode part1]
cctccgcgtaattcag

SEQ ID NO: 40400 - DNA, 16 bp, Artificial Sequence
  synthetic [barcode part1]
cgtgaacagactcgtt

SEQ ID NO: 40401 - DNA, 16 bp, Artificial Sequence
  synthetic [barcode part1]
cgcgcagaagttgagt

SEQ ID NO: 40402 - DNA, 16 bp, Artificial Sequence
  synthetic [barcode part1]
gttgatccacaacacg

SEQ ID NO: 40403 - DNA, 16 bp, Artificial Sequence
  synthetic [barcode part1]
gttacggtctgaggtt

SEQ ID NO: 40404 - DNA, 16 bp, Artificial Sequence
  synthetic [barcode part1]
cagtgagtaggtgtcg

SEQ ID NO: 40405 - DNA, 16 bp, Artificial Sequence
  synthetic [barcode part1]
agatcctatcacggtg

SEQ ID NO: 40406 - DNA, 16 bp, Artificial Sequence
  synthetic [barcode part1]
taggcacgattcacgt

SEQ ID NO: 40407 - DNA, 16 bp, Artificial Sequence
  synthetic [barcode part1]
gtggtgttgcagtact

SEQ ID NO: 40408 - DNA, 16 bp, Artificial Sequence
  synthetic [barcode part1]
ccaactcgtctcttac

SEQ ID NO: 40409 - DNA, 16 bp, Artificial Sequence
  synthetic [barcode part1]
acacctctgacaattc

SEQ ID NO: 40410 - DNA, 16 bp, Artificial Sequence
  synthetic [barcode part1]
tcctcagactgatatc

SEQ ID NO: 40411 - DNA, 16 bp, Artificial Sequence
  synthetic [barcode part1]
tgtgagttggagtggc

SEQ ID NO: 40412 - DNA, 16 bp, Artificial Sequence
  synthetic [barcode part1]
caattatcaggagacg

SEQ ID NO: 40413 - DNA, 16 bp, Artificial Sequence
  synthetic [barcode part1]
tcagtgaacaggaatc

SEQ ID NO: 40414 - DNA, 16 bp, Artificial Sequence
  synthetic [barcode part1]
tcggaacgaacagatt

SEQ ID NO: 40415 - DNA, 16 bp, Artificial Sequence
  synthetic [barcode part1]
attggaccaggagtgc

SEQ ID NO: 40416 - DNA, 16 bp, Artificial Sequence
  synthetic [barcode part1]
tatccgcctcagaacc

SEQ ID NO: 40417 - DNA, 16 bp, Artificial Sequence
  synthetic [barcode part1]
tacgtaattcggcctt

SEQ ID NO: 40418 - DNA, 16 bp, Artificial Sequence
  synthetic [barcode part1]
tgccgacactaatacg

SEQ ID NO: 40419 - DNA, 16 bp, Artificial Sequence
  synthetic [barcode part1]
acagtctgtggtctag

SEQ ID NO: 40420 - DNA, 16 bp, Artificial Sequence
  synthetic [barcode part1]
gtctgccttactcact

SEQ ID NO: 40421 - DNA, 16 bp, Artificial Sequence
  synthetic [barcode part1]
acacaacgaggtcgac

SEQ ID NO: 40422 - DNA, 16 bp, Artificial Sequence
  synthetic [barcode part1]
tggattcagtgaggcg

SEQ ID NO: 40423 - DNA, 16 bp, Artificial Sequence
  synthetic [barcode part1]
ttataggtccgcgagt

SEQ ID NO: 40424 - DNA, 16 bp, Artificial Sequence
  synthetic [barcode part1]
gactacaactagtgcc

SEQ ID NO: 40425 - DNA, 16 bp, Artificial Sequence
  synthetic [barcode part1]
acacgtgataccgtgt

SEQ ID NO: 40426 - DNA, 16 bp, Artificial Sequence
  synthetic [barcode part1]
tctagtgcaagtcgtg

SEQ ID NO: 40427 - DNA, 16 bp, Artificial Sequence
  synthetic [barcode part1]
acttcactcacgtagt

SEQ ID NO: 40428 - DNA, 16 bp, Artificial Sequence
  synthetic [barcode part1]
ttggatcaagaacacg

SEQ ID NO: 40429 - DNA, 16 bp, Artificial Sequence
  synthetic [barcode part1]
tgtcaaggccttcgtc

SEQ ID NO: 40430 - DNA, 16 bp, Artificial Sequence
  synthetic [barcode part1]
agtacgtggaggatcc

SEQ ID NO: 40431 - DNA, 16 bp, Artificial Sequence
  synthetic [barcode part1]
gcgttctggagatatc

SEQ ID NO: 40432 - DNA, 16 bp, Artificial Sequence
  synthetic [barcode part1]
aactggtcctcaagac

SEQ ID NO: 40433 - DNA, 16 bp, Artificial Sequence
  synthetic [barcode part1]
cgttagatcgtgcctc

SEQ ID NO: 40434 - DNA, 16 bp, Artificial Sequence
  synthetic [barcode part1]
cgtctaacggtccttg

SEQ ID NO: 40435 - DNA, 16 bp, Artificial Sequence
  synthetic [barcode part1]
atccgttcactacagt

SEQ ID NO: 40436 - DNA, 16 bp, Artificial Sequence
  synthetic [barcode part1]
ttattgcggcacctgc

SEQ ID NO: 40437 - DNA, 16 bp, Artificial Sequence
  synthetic [barcode part1]
aacgagacggttctct

SEQ ID NO: 40438 - DNA, 16 bp, Artificial Sequence
  synthetic [barcode part1]
gccgacaggattagac

SEQ ID NO: 40439 - DNA, 16 bp, Artificial Sequence
  synthetic [barcode part1]
cggtcggttagttagt

SEQ ID NO: 40440 - DNA, 16 bp, Artificial Sequence
  synthetic [barcode part1]
ttaggcgacgagttct

SEQ ID NO: 40441 - DNA, 16 bp, Artificial Sequence
  synthetic [barcode part1]
aacacctcctacgaag

SEQ ID NO: 40442 - DNA, 16 bp, Artificial Sequence
  synthetic [barcode part1]
taccacctatcggcac

SEQ ID NO: 40443 - DNA, 16 bp, Artificial Sequence
  synthetic [barcode part1]
acaggaggttgttaac

SEQ ID NO: 40444 - DNA, 16 bp, Artificial Sequence
  synthetic [barcode part1]
aattgcgtcctagttc

SEQ ID NO: 40445 - DNA, 16 bp, Artificial Sequence
  synthetic [barcode part1]
tggagttccttaaggc

SEQ ID NO: 40446 - DNA, 16 bp, Artificial Sequence
  synthetic [barcode part1]
attggtcgattggtcg

SEQ ID NO: 40447 - DNA, 16 bp, Artificial Sequence
  synthetic [barcode part1]
atccggacgttgcctt

SEQ ID NO: 40448 - DNA, 16 bp, Artificial Sequence
  synthetic [barcode part1]
tgcagtagataggtac

SEQ ID NO: 40449 - DNA, 16 bp, Artificial Sequence
  synthetic [barcode part1]
tgtacggactcggatt

SEQ ID NO: 40450 - DNA, 16 bp, Artificial Sequence
  synthetic [barcode part1]
ttatcgtagatccgtc

SEQ ID NO: 40451 - DNA, 16 bp, Artificial Sequence
  synthetic [barcode part1]
ttcctgagtactggtt

SEQ ID NO: 40452 - DNA, 16 bp, Artificial Sequence
  synthetic [barcode part1]
gattgcgttccggtct

SEQ ID NO: 40453 - DNA, 16 bp, Artificial Sequence
  synthetic [barcode part1]
acgtacttctacggag

SEQ ID NO: 40454 - DNA, 16 bp, Artificial Sequence
  synthetic [barcode part1]
gaactacgtggtctac

SEQ ID NO: 40455 - DNA, 16 bp, Artificial Sequence
  synthetic [barcode part1]
actaagaagaaggccg

SEQ ID NO: 40456 - DNA, 16 bp, Artificial Sequence
  synthetic [barcode part1]
accacagagacttcgt

SEQ ID NO: 40457 - DNA, 16 bp, Artificial Sequence
  synthetic [barcode part1]
ttctctcaccgatcac

SEQ ID NO: 40458 - DNA, 16 bp, Artificial Sequence
  synthetic [barcode part1]
attctcagacgacttc

SEQ ID NO: 40459 - DNA, 16 bp, Artificial Sequence
  synthetic [barcode part1]
cacagagactagaccg

SEQ ID NO: 40460 - DNA, 16 bp, Artificial Sequence
  synthetic [barcode part1]
ttatcacttcgccacc

SEQ ID NO: 40461 - DNA, 16 bp, Artificial Sequence
  synthetic [barcode part1]
gtcaatctcggaatcg

SEQ ID NO: 40462 - DNA, 16 bp, Artificial Sequence
  synthetic [barcode part1]
atcactcctacggatt

SEQ ID NO: 40463 - DNA, 16 bp, Artificial Sequence
  synthetic [barcode part1]
ttcgcacagttattgc

SEQ ID NO: 40464 - DNA, 16 bp, Artificial Sequence
  synthetic [barcode part1]
tgtgtccagtgactcc

SEQ ID NO: 40465 - DNA, 16 bp, Artificial Sequence
  synthetic [barcode part1]
tgtgaactggacactc

SEQ ID NO: 40466 - DNA, 16 bp, Artificial Sequence
  synthetic [barcode part1]
cctgatctaatcacac

SEQ ID NO: 40467 - DNA, 16 bp, Artificial Sequence
  synthetic [barcode part1]
gtaccagactatctct

SEQ ID NO: 40468 - DNA, 16 bp, Artificial Sequence
  synthetic [barcode part1]
taggactgtgtacacc

SEQ ID NO: 40469 - DNA, 16 bp, Artificial Sequence
  synthetic [barcode part1]
taatcggcgtggtatc

SEQ ID NO: 40470 - DNA, 16 bp, Artificial Sequence
  synthetic [barcode part1]
tcttcaggtgttggtt

SEQ ID NO: 40471 - DNA, 16 bp, Artificial Sequence
  synthetic [barcode part1]
tcacgcggttgtatag

SEQ ID NO: 40472 - DNA, 16 bp, Artificial Sequence
  synthetic [barcode part1]
actcagactataggcc

SEQ ID NO: 40473 - DNA, 16 bp, Artificial Sequence
  synthetic [barcode part1]
gtcgttccaggtactc

SEQ ID NO: 40474 - DNA, 16 bp, Artificial Sequence
  synthetic [barcode part1]
ccaagagttagtgtag

SEQ ID NO: 40475 - DNA, 16 bp, Artificial Sequence
  synthetic [barcode part1]
acttgcctgttgtggc

SEQ ID NO: 40476 - DNA, 16 bp, Artificial Sequence
  synthetic [barcode part1]
ttcgtaggagttcgtg

SEQ ID NO: 40477 - DNA, 16 bp, Artificial Sequence
  synthetic [barcode part1]
ttcaccaggagtgact

SEQ ID NO: 40478 - DNA, 16 bp, Artificial Sequence
  synthetic [barcode part1]
actacaacggacaagt

SEQ ID NO: 40479 - DNA, 16 bp, Artificial Sequence
  synthetic [barcode part1]
gcgtgtgatattgcac

SEQ ID NO: 40480 - DNA, 16 bp, Artificial Sequence
  synthetic [barcode part1]
tccaatccgacgcgtt

SEQ ID NO: 40481 - DNA, 16 bp, Artificial Sequence
  synthetic [barcode part1]
tgtggtacctgagatc

SEQ ID NO: 40482 - DNA, 16 bp, Artificial Sequence
  synthetic [barcode part1]
tgtatcgaagaggttg

SEQ ID NO: 40483 - DNA, 16 bp, Artificial Sequence
  synthetic [barcode part1]
ttggtgttgtgaccag

SEQ ID NO: 40484 - DNA, 16 bp, Artificial Sequence
  synthetic [barcode part1]
cgcaacgttcacttgc

SEQ ID NO: 40485 - DNA, 16 bp, Artificial Sequence
  synthetic [barcode part1]
tcactcggaacgaatc

SEQ ID NO: 40486 - DNA, 16 bp, Artificial Sequence
  synthetic [barcode part1]
acctcactgaacctgc

SEQ ID NO: 40487 - DNA, 16 bp, Artificial Sequence
  synthetic [barcode part1]
aagttgataacacgcg

SEQ ID NO: 40488 - DNA, 16 bp, Artificial Sequence
  synthetic [barcode part1]
cgactcgaatagtctg

SEQ ID NO: 40489 - DNA, 16 bp, Artificial Sequence
  synthetic [barcode part1]
agagtattcctacgcg

SEQ ID NO: 40490 - DNA, 16 bp, Artificial Sequence
  synthetic [barcode part1]
acgaggaattggattc

SEQ ID NO: 40491 - DNA, 16 bp, Artificial Sequence
  synthetic [barcode part1]
gtctgaggtaggttct

SEQ ID NO: 40492 - DNA, 16 bp, Artificial Sequence
  synthetic [barcode part1]
gatatcgtcttcctcc

SEQ ID NO: 40493 - DNA, 16 bp, Artificial Sequence
  synthetic [barcode part1]
actgaacgagtgcgac

SEQ ID NO: 40494 - DNA, 16 bp, Artificial Sequence
  synthetic [barcode part1]
actgcaagacagatac

SEQ ID NO: 40495 - DNA, 16 bp, Artificial Sequence
  synthetic [barcode part1]
accaaggtagtcgcag

SEQ ID NO: 40496 - DNA, 16 bp, Artificial Sequence
  synthetic [barcode part1]
acgcgcactaatcaac

SEQ ID NO: 40497 - DNA, 16 bp, Artificial Sequence
  synthetic [barcode part1]
gtaccgacaatctctt

SEQ ID NO: 40498 - DNA, 16 bp, Artificial Sequence
  synthetic [barcode part1]
aggttattccacgtct

SEQ ID NO: 40499 - DNA, 16 bp, Artificial Sequence
  synthetic [barcode part1]
tgaactgcaacttggc

SEQ ID NO: 40500 - DNA, 16 bp, Artificial Sequence
  synthetic [barcode part1]
gcaagtgagacaagtg

SEQ ID NO: 40501 - DNA, 16 bp, Artificial Sequence
  synthetic [barcode part1]
tgtctcgcctgttatc

SEQ ID NO: 40502 - DNA, 16 bp, Artificial Sequence
  synthetic [barcode part1]
cagtagtcgtgaaggc

SEQ ID NO: 40503 - DNA, 16 bp, Artificial Sequence
  synthetic [barcode part1]
gccgcagttatagtgt

SEQ ID NO: 40504 - DNA, 16 bp, Artificial Sequence
  synthetic [barcode part1]
ttctcgcgtccagtag

SEQ ID NO: 40505 - DNA, 16 bp, Artificial Sequence
  synthetic [barcode part1]
aggtccgtatctcacc

SEQ ID NO: 40506 - DNA, 16 bp, Artificial Sequence
  synthetic [barcode part1]
atctctacctggtaac

SEQ ID NO: 40507 - DNA, 16 bp, Artificial Sequence
  synthetic [barcode part1]
cgttgcctgagagatt

SEQ ID NO: 40508 - DNA, 16 bp, Artificial Sequence
  synthetic [barcode part1]
tcctgtagtcgaatct

SEQ ID NO: 40509 - DNA, 16 bp, Artificial Sequence
  synthetic [barcode part1]
aggtcgttaagagtgt

SEQ ID NO: 40510 - DNA, 16 bp, Artificial Sequence
  synthetic [barcode part1]
acctgtacgacaggag

SEQ ID NO: 40511 - DNA, 16 bp, Artificial Sequence
  synthetic [barcode part1]
agtctcacgagatctg

SEQ ID NO: 40512 - DNA, 16 bp, Artificial Sequence
  synthetic [barcode part1]
atactggcggttctcc

SEQ ID NO: 40513 - DNA, 16 bp, Artificial Sequence
  synthetic [barcode part1]
ccacgtccgtcagatt

SEQ ID NO: 40514 - DNA, 16 bp, Artificial Sequence
  synthetic [barcode part1]
cacgatacaggattcc

SEQ ID NO: 40515 - DNA, 16 bp, Artificial Sequence
  synthetic [barcode part1]
cacctgccttaggact

SEQ ID NO: 40516 - DNA, 16 bp, Artificial Sequence
  synthetic [barcode part1]
agagaactggattcgt

SEQ ID NO: 40517 - DNA, 16 bp, Artificial Sequence
  synthetic [barcode part1]
gtgcgtcgaactagag

SEQ ID NO: 40518 - DNA, 16 bp, Artificial Sequence
  synthetic [barcode part1]
cctcttgtcacacgag

SEQ ID NO: 40519 - DNA, 16 bp, Artificial Sequence
  synthetic [barcode part1]
ccttcgttctgtgttg

SEQ ID NO: 40520 - DNA, 16 bp, Artificial Sequence
  synthetic [barcode part1]
cagttcactcgtaccg

SEQ ID NO: 40521 - DNA, 16 bp, Artificial Sequence
  synthetic [barcode part1]
gcgtcacaacaggtag

SEQ ID NO: 40522 - DNA, 16 bp, Artificial Sequence
  synthetic [barcode part1]
tagactcacctcaccg

SEQ ID NO: 40523 - DNA, 16 bp, Artificial Sequence
  synthetic [barcode part1]
aggtgtccaggtatct

SEQ ID NO: 40524 - DNA, 16 bp, Artificial Sequence
  synthetic [barcode part1]
gttgcaaggtattgcc

SEQ ID NO: 40525 - DNA, 16 bp, Artificial Sequence
  synthetic [barcode part1]
aattccttcctgccac

SEQ ID NO: 40526 - DNA, 16 bp, Artificial Sequence
  synthetic [barcode part1]
gtaacgcagttggtct

SEQ ID NO: 40527 - DNA, 16 bp, Artificial Sequence
  synthetic [barcode part1]
tctactattccgtcgc

SEQ ID NO: 40528 - DNA, 16 bp, Artificial Sequence
  synthetic [barcode part1]
acaaccgtctcggtct

SEQ ID NO: 40529 - DNA, 16 bp, Artificial Sequence
  synthetic [barcode part1]
cgacacagttgcctct

SEQ ID NO: 40530 - DNA, 16 bp, Artificial Sequence
  synthetic [barcode part1]
tcggatacctactatc

SEQ ID NO: 40531 - DNA, 16 bp, Artificial Sequence
  synthetic [barcode part1]
gactgacttaaggcct

SEQ ID NO: 40532 - DNA, 16 bp, Artificial Sequence
  synthetic [barcode part1]
acagatccgatcctcc

SEQ ID NO: 40533 - DNA, 16 bp, Artificial Sequence
  synthetic [barcode part1]
gcctgaggacaagatc

SEQ ID NO: 40534 - DNA, 16 bp, Artificial Sequence
  synthetic [barcode part1]
gacgtattctcaatcc

SEQ ID NO: 40535 - DNA, 16 bp, Artificial Sequence
  synthetic [barcode part1]
aagtgcgtgattcaag

SEQ ID NO: 40536 - DNA, 16 bp, Artificial Sequence
  synthetic [barcode part1]
cggcacttattgtgag

SEQ ID NO: 40537 - DNA, 16 bp, Artificial Sequence
  synthetic [barcode part1]
cgtacgacaagttcgt

SEQ ID NO: 40538 - DNA, 16 bp, Artificial Sequence
  synthetic [barcode part1]
cagtaggacttgtaag

SEQ ID NO: 40539 - DNA, 16 bp, Artificial Sequence
  synthetic [barcode part1]
tagatacgagaaccgt

SEQ ID NO: 40540 - DNA, 16 bp, Artificial Sequence
  synthetic [barcode part1]
ccgtctattgttcacc

SEQ ID NO: 40541 - DNA, 16 bp, Artificial Sequence
  synthetic [barcode part1]
gagtggataggacctc

SEQ ID NO: 40542 - DNA, 16 bp, Artificial Sequence
  synthetic [barcode part1]
cgtccgtagaccttgt

SEQ ID NO: 40543 - DNA, 16 bp, Artificial Sequence
  synthetic [barcode part1]
tcggtcctatcgacgt

SEQ ID NO: 40544 - DNA, 16 bp, Artificial Sequence
  synthetic [barcode part1]
tcggagtgtgatacct

SEQ ID NO: 40545 - DNA, 16 bp, Artificial Sequence
  synthetic [barcode part1]
tccgtctatagtatcg

SEQ ID NO: 40546 - DNA, 16 bp, Artificial Sequence
  synthetic [barcode part1]
tctccacggtagtctg

SEQ ID NO: 40547 - DNA, 16 bp, Artificial Sequence
  synthetic [barcode part1]
tgagtatccaggcgtt

SEQ ID NO: 40548 - DNA, 16 bp, Artificial Sequence
  synthetic [barcode part1]
agagataacaatccgc

SEQ ID NO: 40549 - DNA, 16 bp, Artificial Sequence
  synthetic [barcode part1]
tgaaccgaccgaactt

SEQ ID NO: 40550 - DNA, 16 bp, Artificial Sequence
  synthetic [barcode part1]
acggaaggacctagtc

SEQ ID NO: 40551 - DNA, 16 bp, Artificial Sequence
  synthetic [barcode part1]
aacacaattgccgaag

SEQ ID NO: 40552 - DNA, 16 bp, Artificial Sequence
  synthetic [barcode part1]
gtccactagtaagtgc

SEQ ID NO: 40553 - DNA, 16 bp, Artificial Sequence
  synthetic [barcode part1]
cactccacttggacac

SEQ ID NO: 40554 - DNA, 16 bp, Artificial Sequence
  synthetic [barcode part1]
cggccgaagttaactt

SEQ ID NO: 40555 - DNA, 16 bp, Artificial Sequence
  synthetic [barcode part1]
ccgtattcttgcacct

SEQ ID NO: 40556 - DNA, 16 bp, Artificial Sequence
  synthetic [barcode part1]
gtcggcagttccttac

SEQ ID NO: 40557 - DNA, 16 bp, Artificial Sequence
  synthetic [barcode part1]
aatacttgcctcctag

SEQ ID NO: 40558 - DNA, 16 bp, Artificial Sequence
  synthetic [barcode part1]
gtattctgactcaacc

SEQ ID NO: 40559 - DNA, 16 bp, Artificial Sequence
  synthetic [barcode part1]
cctgtacctagactgc

SEQ ID NO: 40560 - DNA, 16 bp, Artificial Sequence
  synthetic [barcode part1]
cagtaacaatccgacc

SEQ ID NO: 40561 - DNA, 16 bp, Artificial Sequence
  synthetic [barcode part1]
aattggccgactagtc

SEQ ID NO: 40562 - DNA, 16 bp, Artificial Sequence
  synthetic [barcode part1]
gagtactagtgtccac

SEQ ID NO: 40563 - DNA, 16 bp, Artificial Sequence
  synthetic [barcode part1]
tcttcttcctcggagt

SEQ ID NO: 40564 - DNA, 16 bp, Artificial Sequence
  synthetic [barcode part1]
ttgagatacggcgtct

SEQ ID NO: 40565 - DNA, 16 bp, Artificial Sequence
  synthetic [barcode part1]
ttggtagtccgtattc

SEQ ID NO: 40566 - DNA, 16 bp, Artificial Sequence
  synthetic [barcode part1]
gtctccaatccgacac

SEQ ID NO: 40567 - DNA, 16 bp, Artificial Sequence
  synthetic [barcode part1]
ccttaagactcacttg

SEQ ID NO: 40568 - DNA, 16 bp, Artificial Sequence
  synthetic [barcode part1]
gacttggtacgcctct

SEQ ID NO: 40569 - DNA, 16 bp, Artificial Sequence
  synthetic [barcode part1]
aaccggtaccgcaatt

SEQ ID NO: 40570 - DNA, 16 bp, Artificial Sequence
  synthetic [barcode part1]
gtctaaggtaacagac

SEQ ID NO: 40571 - DNA, 16 bp, Artificial Sequence
  synthetic [barcode part1]
gcgtagtcgacgtatt

SEQ ID NO: 40572 - DNA, 16 bp, Artificial Sequence
  synthetic [barcode part1]
tgtctgtaggcggatt

SEQ ID NO: 40573 - DNA, 16 bp, Artificial Sequence
  synthetic [barcode part1]
agaatcacacggattg

SEQ ID NO: 40574 - DNA, 16 bp, Artificial Sequence
  synthetic [barcode part1]
tcaactccgccagtgt

SEQ ID NO: 40575 - DNA, 16 bp, Artificial Sequence
  synthetic [barcode part1]
agtccggagtctaatc

SEQ ID NO: 40576 - DNA, 16 bp, Artificial Sequence
  synthetic [barcode part1]
gattattcaggtcgcg

SEQ ID NO: 40577 - DNA, 16 bp, Artificial Sequence
  synthetic [barcode part1]
ccaatagtgtcagacc

SEQ ID NO: 40578 - DNA, 16 bp, Artificial Sequence
  synthetic [barcode part1]
ttgaacgtatcgttcc

SEQ ID NO: 40579 - DNA, 16 bp, Artificial Sequence
  synthetic [barcode part1]
cgccaacgactagaag

SEQ ID NO: 40580 - DNA, 16 bp, Artificial Sequence
  synthetic [barcode part1]
accttccaactcttcg

SEQ ID NO: 40581 - DNA, 16 bp, Artificial Sequence
  synthetic [barcode part1]
tgcctattgaggtctt

SEQ ID NO: 40582 - DNA, 16 bp, Artificial Sequence
  synthetic [barcode part1]
aattggcgtcgactac

SEQ ID NO: 40583 - DNA, 16 bp, Artificial Sequence
  synthetic [barcode part1]
aattctcagagaccgc

SEQ ID NO: 40584 - DNA, 16 bp, Artificial Sequence
  synthetic [barcode part1]
cagacttgcctacaag

SEQ ID NO: 40585 - DNA, 16 bp, Artificial Sequence
  synthetic [barcode part1]
ataacgaaggtcggag

SEQ ID NO: 40586 - DNA, 16 bp, Artificial Sequence
  synthetic [barcode part1]
gtgagaaggttcaact

SEQ ID NO: 40587 - DNA, 16 bp, Artificial Sequence
  synthetic [barcode part1]
gttcctgtatctctgc

SEQ ID NO: 40588 - DNA, 16 bp, Artificial Sequence
  synthetic [barcode part1]
acgacttgtcctcacg

SEQ ID NO: 40589 - DNA, 16 bp, Artificial Sequence
  synthetic [barcode part1]
tacaacaggacaggtt

SEQ ID NO: 40590 - DNA, 16 bp, Artificial Sequence
  synthetic [barcode part1]
aagagttgaccgagag

SEQ ID NO: 40591 - DNA, 16 bp, Artificial Sequence
  synthetic [barcode part1]
acggtgtgatcgactt

SEQ ID NO: 40592 - DNA, 16 bp, Artificial Sequence
  synthetic [barcode part1]
gtcggtattcaacctt

SEQ ID NO: 40593 - DNA, 16 bp, Artificial Sequence
  synthetic [barcode part1]
aagtcaccactaggtc

SEQ ID NO: 40594 - DNA, 16 bp, Artificial Sequence
  synthetic [barcode part1]
gtctaagatagtaggc

SEQ ID NO: 40595 - DNA, 16 bp, Artificial Sequence
  synthetic [barcode part1]
gattcgactgaactgc

SEQ ID NO: 40596 - DNA, 16 bp, Artificial Sequence
  synthetic [barcode part1]
tgttggaagtggttcc

SEQ ID NO: 40597 - DNA, 16 bp, Artificial Sequence
  synthetic [barcode part1]
acgattgcgactgtac

SEQ ID NO: 40598 - DNA, 16 bp, Artificial Sequence
  synthetic [barcode part1]
tatctacgcaggtgac

SEQ ID NO: 40599 - DNA, 16 bp, Artificial Sequence
  synthetic [barcode part1]
aattcaaccttgtgcc

SEQ ID NO: 40600 - DNA, 16 bp, Artificial Sequence
  synthetic [barcode part1]
cctggtcaactaaggt

SEQ ID NO: 40601 - DNA, 16 bp, Artificial Sequence
  synthetic [barcode part1]
cagtgtggactacact

SEQ ID NO: 40602 - DNA, 16 bp, Artificial Sequence
  synthetic [barcode part1]
attgtcggagaatacg

SEQ ID NO: 40603 - DNA, 16 bp, Artificial Sequence
  synthetic [barcode part1]
cacctcgagacttatt

SEQ ID NO: 40604 - DNA, 16 bp, Artificial Sequence
  synthetic [barcode part1]
caatccaggcaacttg

SEQ ID NO: 40605 - DNA, 16 bp, Artificial Sequence
  synthetic [barcode part1]
gtactgttcacggtag

SEQ ID NO: 40606 - DNA, 16 bp, Artificial Sequence
  synthetic [barcode part1]
gcgtcgaagtctatac

SEQ ID NO: 40607 - DNA, 16 bp, Artificial Sequence
  synthetic [barcode part1]
tacttcagtaggttcc

SEQ ID NO: 40608 - DNA, 16 bp, Artificial Sequence
  synthetic [barcode part1]
actggtgacaaggcgt

SEQ ID NO: 40609 - DNA, 16 bp, Artificial Sequence
  synthetic [barcode part1]
tacgttgttctggttg

SEQ ID NO: 40610 - DNA, 16 bp, Artificial Sequence
  synthetic [barcode part1]
aagactaggtcacgcg

SEQ ID NO: 40611 - DNA, 16 bp, Artificial Sequence
  synthetic [barcode part1]
cagtccgttgttagag

SEQ ID NO: 40612 - DNA, 16 bp, Artificial Sequence
  synthetic [barcode part1]
cgtactccggattacc

SEQ ID NO: 40613 - DNA, 16 bp, Artificial Sequence
  synthetic [barcode part1]
tgacaggatagatctg

SEQ ID NO: 40614 - DNA, 16 bp, Artificial Sequence
  synthetic [barcode part1]
gacacgtgtcaacact

SEQ ID NO: 40615 - DNA, 16 bp, Artificial Sequence
  synthetic [barcode part1]
cctggttagtctcttc

SEQ ID NO: 40616 - DNA, 16 bp, Artificial Sequence
  synthetic [barcode part1]
tccgcacaatccggtt

SEQ ID NO: 40617 - DNA, 16 bp, Artificial Sequence
  synthetic [barcode part1]
atcggactcaccaagt

SEQ ID NO: 40618 - DNA, 16 bp, Artificial Sequence
  synthetic [barcode part1]
gacttacacgaacctg

SEQ ID NO: 40619 - DNA, 16 bp, Artificial Sequence
  synthetic [barcode part1]
cgtagtacctaaggtc

SEQ ID NO: 40620 - DNA, 16 bp, Artificial Sequence
  synthetic [barcode part1]
gaattactgcctctgt

SEQ ID NO: 40621 - DNA, 16 bp, Artificial Sequence
  synthetic [barcode part1]
cggtcggtgatattgt

SEQ ID NO: 40622 - DNA, 16 bp, Artificial Sequence
  synthetic [barcode part1]
gtgagtcgtacaacct

SEQ ID NO: 40623 - DNA, 16 bp, Artificial Sequence
  synthetic [barcode part1]
attctcgaacgcaggt

SEQ ID NO: 40624 - DNA, 16 bp, Artificial Sequence
  synthetic [barcode part1]
gaggtccggataagtc

SEQ ID NO: 40625 - DNA, 16 bp, Artificial Sequence
  synthetic [barcode part1]
gtatcacgttcgcctg

SEQ ID NO: 40626 - DNA, 16 bp, Artificial Sequence
  synthetic [barcode part1]
tggagaggcactaacc

SEQ ID NO: 40627 - DNA, 16 bp, Artificial Sequence
  synthetic [barcode part1]
cgcctacgataccact

SEQ ID NO: 40628 - DNA, 16 bp, Artificial Sequence
  synthetic [barcode part1]
caagtcacctccgtac

SEQ ID NO: 40629 - DNA, 16 bp, Artificial Sequence
  synthetic [barcode part1]
gccgtacctagtatag

SEQ ID NO: 40630 - DNA, 16 bp, Artificial Sequence
  synthetic [barcode part1]
agatcggtgcgactag

SEQ ID NO: 40631 - DNA, 16 bp, Artificial Sequence
  synthetic [barcode part1]
cagtggtatcgtcagt

SEQ ID NO: 40632 - DNA, 16 bp, Artificial Sequence
  synthetic [barcode part1]
gtcgcgttaacttccg

SEQ ID NO: 40633 - DNA, 16 bp, Artificial Sequence
  synthetic [barcode part1]
ccgttgttgcctagac

SEQ ID NO: 40634 - DNA, 16 bp, Artificial Sequence
  synthetic [barcode part1]
gagtggaagacgaatc

SEQ ID NO: 40635 - DNA, 16 bp, Artificial Sequence
  synthetic [barcode part1]
gacttcttcagtgtgt

SEQ ID NO: 40636 - DNA, 16 bp, Artificial Sequence
  synthetic [barcode part1]
ccacactacaacttac

SEQ ID NO: 40637 - DNA, 16 bp, Artificial Sequence
  synthetic [barcode part1]
tgtcctactacggatt

SEQ ID NO: 40638 - DNA, 16 bp, Artificial Sequence
  synthetic [barcode part1]
cgtgatactacctgcc

SEQ ID NO: 40639 - DNA, 16 bp, Artificial Sequence
  synthetic [barcode part1]
cgagtccttgtcctag

SEQ ID NO: 40640 - DNA, 16 bp, Artificial Sequence
  synthetic [barcode part1]
atcacagatctcggac

SEQ ID NO: 40641 - DNA, 16 bp, Artificial Sequence
  synthetic [barcode part1]
gtgacttgcaaggacg

SEQ ID NO: 40642 - DNA, 16 bp, Artificial Sequence
  synthetic [barcode part1]
ttaacctcttggcctc

SEQ ID NO: 40643 - DNA, 16 bp, Artificial Sequence
  synthetic [barcode part1]
cgagaagtagtacgcc

SEQ ID NO: 40644 - DNA, 16 bp, Artificial Sequence
  synthetic [barcode part1]
tacctgttccaaggtt

SEQ ID NO: 40645 - DNA, 16 bp, Artificial Sequence
  synthetic [barcode part1]
cacagatatccacgac

SEQ ID NO: 40646 - DNA, 16 bp, Artificial Sequence
  synthetic [barcode part1]
ccgcgagatagagtgt

SEQ ID NO: 40647 - DNA, 16 bp, Artificial Sequence
  synthetic [barcode part1]
agacacgtgataatcg

SEQ ID NO: 40648 - DNA, 16 bp, Artificial Sequence
  synthetic [barcode part1]
cagagtcacgtgtgtt

SEQ ID NO: 40649 - DNA, 16 bp, Artificial Sequence
  synthetic [barcode part1]
gtctcactctgacttc

SEQ ID NO: 40650 - DNA, 16 bp, Artificial Sequence
  synthetic [barcode part1]
cggaccagtactcttc

SEQ ID NO: 40651 - DNA, 16 bp, Artificial Sequence
  synthetic [barcode part1]
cgaggtagtgactgtg

SEQ ID NO: 40652 - DNA, 16 bp, Artificial Sequence
  synthetic [barcode part1]
cgattgttactctgtg

SEQ ID NO: 40653 - DNA, 16 bp, Artificial Sequence
  synthetic [barcode part1]
tacagaacaacaaccg

SEQ ID NO: 40654 - DNA, 16 bp, Artificial Sequence
  synthetic [barcode part1]
acacgacaatcttcct

SEQ ID NO: 40655 - DNA, 16 bp, Artificial Sequence
  synthetic [barcode part1]
gcaactggtaccagtt

SEQ ID NO: 40656 - DNA, 16 bp, Artificial Sequence
  synthetic [barcode part1]
atacgtaggccgactt

SEQ ID NO: 40657 - DNA, 16 bp, Artificial Sequence
  synthetic [barcode part1]
tatcgtcagacacctt

SEQ ID NO: 40658 - DNA, 16 bp, Artificial Sequence
  synthetic [barcode part1]
ttggtggacaaggatt

SEQ ID NO: 40659 - DNA, 16 bp, Artificial Sequence
  synthetic [barcode part1]
gcgtaactaaccacgt

SEQ ID NO: 40660 - DNA, 16 bp, Artificial Sequence
  synthetic [barcode part1]
atactgcgaacctcag

SEQ ID NO: 40661 - DNA, 16 bp, Artificial Sequence
  synthetic [barcode part1]
ttgatatacaccggcg

SEQ ID NO: 40662 - DNA, 16 bp, Artificial Sequence
  synthetic [barcode part1]
gttggacacctagtgt

SEQ ID NO: 40663 - DNA, 16 bp, Artificial Sequence
  synthetic [barcode part1]
ttgtcgattggaccag

SEQ ID NO: 40664 - DNA, 16 bp, Artificial Sequence
  synthetic [barcode part1]
ttatcctggtcgcacg

SEQ ID NO: 40665 - DNA, 16 bp, Artificial Sequence
  synthetic [barcode part1]
taatcggcacgtacac

SEQ ID NO: 40666 - DNA, 16 bp, Artificial Sequence
  synthetic [barcode part1]
tctgcctgccttgaag

SEQ ID NO: 40667 - DNA, 16 bp, Artificial Sequence
  synthetic [barcode part1]
cgttactacagtcact

SEQ ID NO: 40668 - DNA, 16 bp, Artificial Sequence
  synthetic [barcode part1]
tgaatccgacgttcag

SEQ ID NO: 40669 - DNA, 16 bp, Artificial Sequence
  synthetic [barcode part1]
tagtacggacttacgc

SEQ ID NO: 40670 - DNA, 16 bp, Artificial Sequence
  synthetic [barcode part1]
cgcgtgaagtgtattc

SEQ ID NO: 40671 - DNA, 16 bp, Artificial Sequence
  synthetic [barcode part1]
gcaactaatcaacgcc

SEQ ID NO: 40672 - DNA, 16 bp, Artificial Sequence
  synthetic [barcode part1]
ttgtaggtggatctgc

SEQ ID NO: 40673 - DNA, 16 bp, Artificial Sequence
  synthetic [barcode part1]
aggagtatcgtgcctt

SEQ ID NO: 40674 - DNA, 16 bp, Artificial Sequence
  synthetic [barcode part1]
atacacacaacgccgt

SEQ ID NO: 40675 - DNA, 16 bp, Artificial Sequence
  synthetic [barcode part1]
accgttagattcggtg

SEQ ID NO: 40676 - DNA, 16 bp, Artificial Sequence
  synthetic [barcode part1]
ttacttcgcgttcaag

SEQ ID NO: 40677 - DNA, 16 bp, Artificial Sequence
  synthetic [barcode part1]
ttatcctcgacctctg

SEQ ID NO: 40678 - DNA, 16 bp, Artificial Sequence
  synthetic [barcode part1]
attctattgccggtgt

SEQ ID NO: 40679 - DNA, 16 bp, Artificial Sequence
  synthetic [barcode part1]
ttcggttgttgacact

SEQ ID NO: 40680 - DNA, 16 bp, Artificial Sequence
  synthetic [barcode part1]
gatagagaggacggtt

SEQ ID NO: 40681 - DNA, 16 bp, Artificial Sequence
  synthetic [barcode part1]
ccaagtgtgagacggt

SEQ ID NO: 40682 - DNA, 16 bp, Artificial Sequence
  synthetic [barcode part1]
cctctaggttggtgtc

SEQ ID NO: 40683 - DNA, 16 bp, Artificial Sequence
  synthetic [barcode part1]
tataagtcactgcctc

SEQ ID NO: 40684 - DNA, 16 bp, Artificial Sequence
  synthetic [barcode part1]
gacgagtcagaactcg

SEQ ID NO: 40685 - DNA, 16 bp, Artificial Sequence
  synthetic [barcode part1]
tggacgaagacctcag

SEQ ID NO: 40686 - DNA, 16 bp, Artificial Sequence
  synthetic [barcode part1]
acggaactactgtctg

SEQ ID NO: 40687 - DNA, 16 bp, Artificial Sequence
  synthetic [barcode part1]
cagtcagaccaatcgt

SEQ ID NO: 40688 - DNA, 16 bp, Artificial Sequence
  synthetic [barcode part1]
cacggtcctctactag

SEQ ID NO: 40689 - DNA, 16 bp, Artificial Sequence
  synthetic [barcode part1]
actcagacagaacaac

SEQ ID NO: 40690 - DNA, 16 bp, Artificial Sequence
  synthetic [barcode part1]
atagttgcggcgtact

SEQ ID NO: 40691 - DNA, 16 bp, Artificial Sequence
  synthetic [barcode part1]
acagttcggtgcagag

SEQ ID NO: 40692 - DNA, 16 bp, Artificial Sequence
  synthetic [barcode part1]
tgaatacaaggcgact

SEQ ID NO: 40693 - DNA, 16 bp, Artificial Sequence
  synthetic [barcode part1]
gtccgttctcagaacc

SEQ ID NO: 40694 - DNA, 16 bp, Artificial Sequence
  synthetic [barcode part1]
cgttcactattgcggc

SEQ ID NO: 40695 - DNA, 16 bp, Artificial Sequence
  synthetic [barcode part1]
ccgtcgtagatccgtt

SEQ ID NO: 40696 - DNA, 16 bp, Artificial Sequence
  synthetic [barcode part1]
attccacgccttctgt

SEQ ID NO: 40697 - DNA, 16 bp, Artificial Sequence
  synthetic [barcode part1]
tcaaggtgtgaacaac

SEQ ID NO: 40698 - DNA, 16 bp, Artificial Sequence
  synthetic [barcode part1]
tatcctggcggacctt

SEQ ID NO: 40699 - DNA, 16 bp, Artificial Sequence
  synthetic [barcode part1]
ccaggtgactctgttc

SEQ ID NO: 40700 - DNA, 16 bp, Artificial Sequence
  synthetic [barcode part1]
tcctagtctctcgact

SEQ ID NO: 40701 - DNA, 16 bp, Artificial Sequence
  synthetic [barcode part1]
cagattgttagtggcc

SEQ ID NO: 40702 - DNA, 16 bp, Artificial Sequence
  synthetic [barcode part1]
gaagtgaccaccttgt

SEQ ID NO: 40703 - DNA, 16 bp, Artificial Sequence
  synthetic [barcode part1]
agatagacaggtaggc

SEQ ID NO: 40704 - DNA, 16 bp, Artificial Sequence
  synthetic [barcode part1]
gttgtctacggcaagt

SEQ ID NO: 40705 - DNA, 16 bp, Artificial Sequence
  synthetic [barcode part1]
cgtgtaagttcggatc

SEQ ID NO: 40706 - DNA, 16 bp, Artificial Sequence
  synthetic [barcode part1]
tccgatcacaccaacc

SEQ ID NO: 40707 - DNA, 16 bp, Artificial Sequence
  synthetic [barcode part1]
gacacacacactggtt

SEQ ID NO: 40708 - DNA, 16 bp, Artificial Sequence
  synthetic [barcode part1]
cactctatccgtcact

SEQ ID NO: 40709 - DNA, 16 bp, Artificial Sequence
  synthetic [barcode part1]
tgtgacactcgagatc

SEQ ID NO: 40710 - DNA, 16 bp, Artificial Sequence
  synthetic [barcode part1]
gttagtcgttggtcag

SEQ ID NO: 40711 - DNA, 16 bp, Artificial Sequence
  synthetic [barcode part1]
gacgagaatcactctc

SEQ ID NO: 40712 - DNA, 16 bp, Artificial Sequence
  synthetic [barcode part1]
aacaaccgaggtgtgc

SEQ ID NO: 40713 - DNA, 16 bp, Artificial Sequence
  synthetic [barcode part1]
acaggacgaattcgcg

SEQ ID NO: 40714 - DNA, 16 bp, Artificial Sequence
  synthetic [barcode part1]
aatcagttgcacgcgt

SEQ ID NO: 40715 - DNA, 16 bp, Artificial Sequence
  synthetic [barcode part1]
ttccgcacggtagttc

SEQ ID NO: 40716 - DNA, 16 bp, Artificial Sequence
  synthetic [barcode part1]
tcaggcgataagtctc

SEQ ID NO: 40717 - DNA, 16 bp, Artificial Sequence
  synthetic [barcode part1]
gcgtcagtaatagaac

SEQ ID NO: 40718 - DNA, 16 bp, Artificial Sequence
  synthetic [barcode part1]
cgattgtccgtacaag

SEQ ID NO: 40719 - DNA, 16 bp, Artificial Sequence
  synthetic [barcode part1]
aagtggacagacgagt

SEQ ID NO: 40720 - DNA, 16 bp, Artificial Sequence
  synthetic [barcode part1]
aacgatcggttaccac

SEQ ID NO: 40721 - DNA, 16 bp, Artificial Sequence
  synthetic [barcode part1]
actacgtgttgaagag

SEQ ID NO: 40722 - DNA, 16 bp, Artificial Sequence
  synthetic [barcode part1]
gaggtgacgaagtaac

SEQ ID NO: 40723 - DNA, 16 bp, Artificial Sequence
  synthetic [barcode part1]
aaccaacacacgtacc

SEQ ID NO: 40724 - DNA, 16 bp, Artificial Sequence
  synthetic [barcode part1]
gtggcacagttaatcc

SEQ ID NO: 40725 - DNA, 16 bp, Artificial Sequence
  synthetic [barcode part1]
agtactgtcgattggc

SEQ ID NO: 40726 - DNA, 16 bp, Artificial Sequence
  synthetic [barcode part1]
gagttgtagacacggc

SEQ ID NO: 40727 - DNA, 16 bp, Artificial Sequence
  synthetic [barcode part1]
tgagactggccttaac

SEQ ID NO: 40728 - DNA, 16 bp, Artificial Sequence
  synthetic [barcode part1]
gaacggagttccagac

SEQ ID NO: 40729 - DNA, 16 bp, Artificial Sequence
  synthetic [barcode part1]
gcctgagataagtctc

SEQ ID NO: 40730 - DNA, 16 bp, Artificial Sequence
  synthetic [barcode part1]
ccaacctctcacagac

SEQ ID NO: 40731 - DNA, 16 bp, Artificial Sequence
  synthetic [barcode part1]
cgagattctggaactc

SEQ ID NO: 40732 - DNA, 16 bp, Artificial Sequence
  synthetic [barcode part1]
aatagagtcctgtcgc

SEQ ID NO: 40733 - DNA, 16 bp, Artificial Sequence
  synthetic [barcode part1]
atatatccgtcctacg

SEQ ID NO: 40734 - DNA, 16 bp, Artificial Sequence
  synthetic [barcode part1]
attaacactgtcgtcc

SEQ ID NO: 40735 - DNA, 16 bp, Artificial Sequence
  synthetic [barcode part1]
attacgccggtaggag

SEQ ID NO: 40736 - DNA, 16 bp, Artificial Sequence
  synthetic [barcode part1]
cgatcaagtattgcgc

SEQ ID NO: 40737 - DNA, 16 bp, Artificial Sequence
  synthetic [barcode part1]
accaggtggcgtaagt

SEQ ID NO: 40738 - DNA, 16 bp, Artificial Sequence
  synthetic [barcode part1]
tcctgattcaacacgt

SEQ ID NO: 40739 - DNA, 16 bp, Artificial Sequence
  synthetic [barcode part1]
gcgtctcttagtgatt

SEQ ID NO: 40740 - DNA, 16 bp, Artificial Sequence
  synthetic [barcode part1]
attctacgacggtgac

SEQ ID NO: 40741 - DNA, 16 bp, Artificial Sequence
  synthetic [barcode part1]
tagtaacgccactggt

SEQ ID NO: 40742 - DNA, 16 bp, Artificial Sequence
  synthetic [barcode part1]
caccgaagtagaagtt

SEQ ID NO: 40743 - DNA, 16 bp, Artificial Sequence
  synthetic [barcode part1]
tgagaattctgtgccg

SEQ ID NO: 40744 - DNA, 16 bp, Artificial Sequence
  synthetic [barcode part1]
aagactaccgaatacg

SEQ ID NO: 40745 - DNA, 16 bp, Artificial Sequence
  synthetic [barcode part1]
tgttaataagaggccg

SEQ ID NO: 40746 - DNA, 16 bp, Artificial Sequence
  synthetic [barcode part1]
aactcagacacttctc

SEQ ID NO: 40747 - DNA, 16 bp, Artificial Sequence
  synthetic [barcode part1]
accggcgacttaagtt

SEQ ID NO: 40748 - DNA, 16 bp, Artificial Sequence
  synthetic [barcode part1]
tcttcggcacgattgc

SEQ ID NO: 40749 - DNA, 16 bp, Artificial Sequence
  synthetic [barcode part1]
tgttatctccgcaggc

SEQ ID NO: 40750 - DNA, 16 bp, Artificial Sequence
  synthetic [barcode part1]
ttcaggagtcgtgatc

SEQ ID NO: 40751 - DNA, 16 bp, Artificial Sequence
  synthetic [barcode part1]
atagaggcctctgtgt

SEQ ID NO: 40752 - DNA, 16 bp, Artificial Sequence
  synthetic [barcode part1]
aagtcgccagactact

SEQ ID NO: 40753 - DNA, 16 bp, Artificial Sequence
  synthetic [barcode part1]
tgaccttgcgttgatt

SEQ ID NO: 40754 - DNA, 16 bp, Artificial Sequence
  synthetic [barcode part1]
cacacaacacttcgcc

SEQ ID NO: 40755 - DNA, 16 bp, Artificial Sequence
  synthetic [barcode part1]
gaccagtctagttggt

SEQ ID NO: 40756 - DNA, 16 bp, Artificial Sequence
  synthetic [barcode part1]
cactactggatactct

SEQ ID NO: 40757 - DNA, 16 bp, Artificial Sequence
  synthetic [barcode part1]
atagagtgagtccgcg

SEQ ID NO: 40758 - DNA, 16 bp, Artificial Sequence
  synthetic [barcode part1]
taggtgcaaggtgatt

SEQ ID NO: 40759 - DNA, 16 bp, Artificial Sequence
  synthetic [barcode part1]
actctgtggcagtagt

SEQ ID NO: 40760 - DNA, 16 bp, Artificial Sequence
  synthetic [barcode part1]
aattacaggtcggaac

SEQ ID NO: 40761 - DNA, 16 bp, Artificial Sequence
  synthetic [barcode part1]
agaagattagacctgc

SEQ ID NO: 40762 - DNA, 16 bp, Artificial Sequence
  synthetic [barcode part1]
tagaggagtcgatact

SEQ ID NO: 40763 - DNA, 16 bp, Artificial Sequence
  synthetic [barcode part1]
gtgtgcactccttctt

SEQ ID NO: 40764 - DNA, 16 bp, Artificial Sequence
  synthetic [barcode part1]
taccaggaacacaagt

SEQ ID NO: 40765 - DNA, 16 bp, Artificial Sequence
  synthetic [barcode part1]
tcggacgttattccgc

SEQ ID NO: 40766 - DNA, 16 bp, Artificial Sequence
  synthetic [barcode part1]
tccaagaactgcgatc

SEQ ID NO: 40767 - DNA, 16 bp, Artificial Sequence
  synthetic [barcode part1]
ccgtgtcttattgagt

SEQ ID NO: 40768 - DNA, 16 bp, Artificial Sequence
  synthetic [barcode part1]
actctcctcttccaag

SEQ ID NO: 40769 - DNA, 16 bp, Artificial Sequence
  synthetic [barcode part1]
atcgtgtcaactcttg

SEQ ID NO: 40770 - DNA, 16 bp, Artificial Sequence
  synthetic [barcode part1]
gcgtaattgtggttgc

SEQ ID NO: 40771 - DNA, 16 bp, Artificial Sequence
  synthetic [barcode part1]
caaccggttaattggc

SEQ ID NO: 40772 - DNA, 16 bp, Artificial Sequence
  synthetic [barcode part1]
gcgagaggattcggtt

SEQ ID NO: 40773 - DNA, 16 bp, Artificial Sequence
  synthetic [barcode part1]
gccgtagtctatctgc

SEQ ID NO: 40774 - DNA, 16 bp, Artificial Sequence
  synthetic [barcode part1]
gacggcgtacttgaag

SEQ ID NO: 40775 - DNA, 16 bp, Artificial Sequence
  synthetic [barcode part1]
tgcagagattgttgag

SEQ ID NO: 40776 - DNA, 16 bp, Artificial Sequence
  synthetic [barcode part1]
attgataggtgacgac

SEQ ID NO: 40777 - DNA, 16 bp, Artificial Sequence
  synthetic [barcode part1]
gtgaccgtgatatacc

SEQ ID NO: 40778 - DNA, 16 bp, Artificial Sequence
  synthetic [barcode part1]
tccttagtgtacggtt

SEQ ID NO: 40779 - DNA, 16 bp, Artificial Sequence
  synthetic [barcode part1]
taacacggattgtgcc

SEQ ID NO: 40780 - DNA, 16 bp, Artificial Sequence
  synthetic [barcode part1]
tcggcggttacgttct

SEQ ID NO: 40781 - DNA, 16 bp, Artificial Sequence
  synthetic [barcode part1]
cctattgttgacgtgt

SEQ ID NO: 40782 - DNA, 16 bp, Artificial Sequence
  synthetic [barcode part1]
aagagtaggtgcagac

SEQ ID NO: 40783 - DNA, 16 bp, Artificial Sequence
  synthetic [barcode part1]
cgtcactcttgacttc

SEQ ID NO: 40784 - DNA, 16 bp, Artificial Sequence
  synthetic [barcode part1]
tcctggtgatcgtgtc

SEQ ID NO: 40785 - DNA, 16 bp, Artificial Sequence
  synthetic [barcode part1]
caatccacaggaatag

SEQ ID NO: 40786 - DNA, 16 bp, Artificial Sequence
  synthetic [barcode part1]
atactcctacgcctct

SEQ ID NO: 40787 - DNA, 16 bp, Artificial Sequence
  synthetic [barcode part1]
cggtgattgcgttcct

SEQ ID NO: 40788 - DNA, 16 bp, Artificial Sequence
  synthetic [barcode part1]
ccgttggtgcaagaag

SEQ ID NO: 40789 - DNA, 16 bp, Artificial Sequence
  synthetic [barcode part1]
taacctgcagatcacg

SEQ ID NO: 40790 - DNA, 16 bp, Artificial Sequence
  synthetic [barcode part1]
tcctgcgtacaagagt

SEQ ID NO: 40791 - DNA, 16 bp, Artificial Sequence
  synthetic [barcode part1]
acacttcctctcacgt

SEQ ID NO: 40792 - DNA, 16 bp, Artificial Sequence
  synthetic [barcode part1]
tcctgtacgtggaagt

SEQ ID NO: 40793 - DNA, 16 bp, Artificial Sequence
  synthetic [barcode part1]
agtgaatacctcgaag

SEQ ID NO: 40794 - DNA, 16 bp, Artificial Sequence
  synthetic [barcode part1]
cctagtaactcttacg

SEQ ID NO: 40795 - DNA, 16 bp, Artificial Sequence
  synthetic [barcode part1]
tgtgtgtgttggtcag

SEQ ID NO: 40796 - DNA, 16 bp, Artificial Sequence
  synthetic [barcode part1]
ttccgtcttgtaggcg

SEQ ID NO: 40797 - DNA, 16 bp, Artificial Sequence
  synthetic [barcode part1]
ttgttaccagacactc

SEQ ID NO: 40798 - DNA, 16 bp, Artificial Sequence
  synthetic [barcode part1]
gaaccgaattgtacag

SEQ ID NO: 40799 - DNA, 16 bp, Artificial Sequence
  synthetic [barcode part1]
gccagtagtctctcgt

SEQ ID NO: 40800 - DNA, 16 bp, Artificial Sequence
  synthetic [barcode part1]
taacacgtaacctctc

SEQ ID NO: 40801 - DNA, 16 bp, Artificial Sequence
  synthetic [barcode part1]
gcacagtagaactagt

SEQ ID NO: 40802 - DNA, 16 bp, Artificial Sequence
  synthetic [barcode part1]
ccgtggttaataccag

SEQ ID NO: 40803 - DNA, 16 bp, Artificial Sequence
  synthetic [barcode part1]
gtacgagtaagttacg

SEQ ID NO: 40804 - DNA, 16 bp, Artificial Sequence
  synthetic [barcode part1]
gaagtgccgacctaag

SEQ ID NO: 40805 - DNA, 16 bp, Artificial Sequence
  synthetic [barcode part1]
cgcacgacgtcttatc

SEQ ID NO: 40806 - DNA, 16 bp, Artificial Sequence
  synthetic [barcode part1]
tcggaccttgatagtg

SEQ ID NO: 40807 - DNA, 16 bp, Artificial Sequence
  synthetic [barcode part1]
ccgcctcgtacttaag

SEQ ID NO: 40808 - DNA, 16 bp, Artificial Sequence
  synthetic [barcode part1]
atcaggttgccaagtc

SEQ ID NO: 40809 - DNA, 16 bp, Artificial Sequence
  synthetic [barcode part1]
cctggtgatccttacg

SEQ ID NO: 40810 - DNA, 16 bp, Artificial Sequence
  synthetic [barcode part1]
cgtgaagtagtggtcg

SEQ ID NO: 40811 - DNA, 16 bp, Artificial Sequence
  synthetic [barcode part1]
aatcggttagtgtcgc

SEQ ID NO: 40812 - DNA, 16 bp, Artificial Sequence
  synthetic [barcode part1]
tctctctcggtgttac

SEQ ID NO: 40813 - DNA, 16 bp, Artificial Sequence
  synthetic [barcode part1]
gacaccaactggttgt

SEQ ID NO: 40814 - DNA, 16 bp, Artificial Sequence
  synthetic [barcode part1]
gtgacacactgtgact

SEQ ID NO: 40815 - DNA, 16 bp, Artificial Sequence
  synthetic [barcode part1]
acagttactggtcctt

SEQ ID NO: 40816 - DNA, 16 bp, Artificial Sequence
  synthetic [barcode part1]
gtatacctagaaggtg

SEQ ID NO: 40817 - DNA, 16 bp, Artificial Sequence
  synthetic [barcode part1]
accaccttagatactc

SEQ ID NO: 40818 - DNA, 16 bp, Artificial Sequence
  synthetic [barcode part1]
gtctgccttgtctact

SEQ ID NO: 40819 - DNA, 16 bp, Artificial Sequence
  synthetic [barcode part1]
gtcgcactcctgttag

SEQ ID NO: 40820 - DNA, 16 bp, Artificial Sequence
  synthetic [barcode part1]
tcagtggcgagttact

SEQ ID NO: 40821 - DNA, 16 bp, Artificial Sequence
  synthetic [barcode part1]
tctaacgtatcggacg

SEQ ID NO: 40822 - DNA, 16 bp, Artificial Sequence
  synthetic [barcode part1]
ataccagagagattgc

SEQ ID NO: 40823 - DNA, 16 bp, Artificial Sequence
  synthetic [barcode part1]
gtaagtcgccgaagac

SEQ ID NO: 40824 - DNA, 16 bp, Artificial Sequence
  synthetic [barcode part1]
ttcctggtaacgtatc

SEQ ID NO: 40825 - DNA, 16 bp, Artificial Sequence
  synthetic [barcode part1]
tcgagacggattctgt

SEQ ID NO: 40826 - DNA, 16 bp, Artificial Sequence
  synthetic [barcode part1]
agtagtcctccacacc

SEQ ID NO: 40827 - DNA, 16 bp, Artificial Sequence
  synthetic [barcode part1]
cctactgtatagatcc

SEQ ID NO: 40828 - DNA, 16 bp, Artificial Sequence
  synthetic [barcode part1]
gagtcaggactagaag

SEQ ID NO: 40829 - DNA, 16 bp, Artificial Sequence
  synthetic [barcode part1]
ttgttgttgcctgaac

SEQ ID NO: 40830 - DNA, 16 bp, Artificial Sequence
  synthetic [barcode part1]
aggcggcgtacttaag

SEQ ID NO: 40831 - DNA, 16 bp, Artificial Sequence
  synthetic [barcode part1]
ttccgacgagataacc

SEQ ID NO: 40832 - DNA, 16 bp, Artificial Sequence
  synthetic [barcode part1]
tgagtcaagtcactgc

SEQ ID NO: 40833 - DNA, 16 bp, Artificial Sequence
  synthetic [barcode part1]
gtaagaacctcacacc

SEQ ID NO: 40834 - DNA, 16 bp, Artificial Sequence
  synthetic [barcode part1]
tagaggaaccggcact

SEQ ID NO: 40835 - DNA, 16 bp, Artificial Sequence
  synthetic [barcode part1]
gtaactactctccagt

SEQ ID NO: 40836 - DNA, 16 bp, Artificial Sequence
  synthetic [barcode part1]
acgcctcgactcaact

SEQ ID NO: 40837 - DNA, 16 bp, Artificial Sequence
  synthetic [barcode part1]
cgactattccgactcg

SEQ ID NO: 40838 - DNA, 16 bp, Artificial Sequence
  synthetic [barcode part1]
taccttggtaagtcct

SEQ ID NO: 40839 - DNA, 16 bp, Artificial Sequence
  synthetic [barcode part1]
taccgttacctcctgt

SEQ ID NO: 40840 - DNA, 16 bp, Artificial Sequence
  synthetic [barcode part1]
cggaaggtctcaatct

SEQ ID NO: 40841 - DNA, 16 bp, Artificial Sequence
  synthetic [barcode part1]
gtctctcagagttgag

SEQ ID NO: 40842 - DNA, 16 bp, Artificial Sequence
  synthetic [barcode part1]
cggcgacctaacaatt

SEQ ID NO: 40843 - DNA, 16 bp, Artificial Sequence
  synthetic [barcode part1]
ccgtcacacaataggt

SEQ ID NO: 40844 - DNA, 16 bp, Artificial Sequence
  synthetic [barcode part1]
atctgacactgtcgag

SEQ ID NO: 40845 - DNA, 16 bp, Artificial Sequence
  synthetic [barcode part1]
attgaccgtcgtagtg

SEQ ID NO: 40846 - DNA, 16 bp, Artificial Sequence
  synthetic [barcode part1]
cgaattgcgcacttcc

SEQ ID NO: 40847 - DNA, 16 bp, Artificial Sequence
  synthetic [barcode part1]
cggttcttcttctgac

SEQ ID NO: 40848 - DNA, 16 bp, Artificial Sequence
  synthetic [barcode part1]
gaggcagtcgtggatt

SEQ ID NO: 40849 - DNA, 16 bp, Artificial Sequence
  synthetic [barcode part1]
actgtacggagtggtg

SEQ ID NO: 40850 - DNA, 16 bp, Artificial Sequence
  synthetic [barcode part1]
gtccttgagattactc

SEQ ID NO: 40851 - DNA, 16 bp, Artificial Sequence
  synthetic [barcode part1]
ttgtacggaggagtcg

SEQ ID NO: 40852 - DNA, 16 bp, Artificial Sequence
  synthetic [barcode part1]
attctctctctccgag

SEQ ID NO: 40853 - DNA, 16 bp, Artificial Sequence
  synthetic [barcode part1]
gattcggcgtgtcctt

SEQ ID NO: 40854 - DNA, 16 bp, Artificial Sequence
  synthetic [barcode part1]
aggttaagttggcgcg

SEQ ID NO: 40855 - DNA, 16 bp, Artificial Sequence
  synthetic [barcode part1]
tgaagtaaggcgcctg

SEQ ID NO: 40856 - DNA, 16 bp, Artificial Sequence
  synthetic [barcode part1]
gaactgttcgtacttc

SEQ ID NO: 40857 - DNA, 16 bp, Artificial Sequence
  synthetic [barcode part1]
tgtatcgatcgacgtg

SEQ ID NO: 40858 - DNA, 16 bp, Artificial Sequence
  synthetic [barcode part1]
taccaacgtcagtacg

SEQ ID NO: 40859 - DNA, 16 bp, Artificial Sequence
  synthetic [barcode part1]
aacggaactctaccgt

SEQ ID NO: 40860 - DNA, 16 bp, Artificial Sequence
  synthetic [barcode part1]
tggacttgtcctgtcg

SEQ ID NO: 40861 - DNA, 16 bp, Artificial Sequence
  synthetic [barcode part1]
ttgccgcctacggatt

SEQ ID NO: 40862 - DNA, 16 bp, Artificial Sequence
  synthetic [barcode part1]
acactgagaggcagtc

SEQ ID NO: 40863 - DNA, 16 bp, Artificial Sequence
  synthetic [barcode part1]
gcaattggaagtcggc

SEQ ID NO: 40864 - DNA, 16 bp, Artificial Sequence
  synthetic [barcode part1]
gactacaattgcgtgc

SEQ ID NO: 40865 - DNA, 16 bp, Artificial Sequence
  synthetic [barcode part1]
aacaagacgcgaattc

SEQ ID NO: 40866 - DNA, 16 bp, Artificial Sequence
  synthetic [barcode part1]
cagaattcgcgacact

SEQ ID NO: 40867 - DNA, 16 bp, Artificial Sequence
  synthetic [barcode part1]
tcttgacgtacggcct

SEQ ID NO: 40868 - DNA, 16 bp, Artificial Sequence
  synthetic [barcode part1]
atactccgtacggagt

SEQ ID NO: 40869 - DNA, 16 bp, Artificial Sequence
  synthetic [barcode part1]
atcgtctggacctatt

SEQ ID NO: 40870 - DNA, 16 bp, Artificial Sequence
  synthetic [barcode part1]
taacgcgcctccagtt

SEQ ID NO: 40871 - DNA, 16 bp, Artificial Sequence
  synthetic [barcode part1]
tacacgtccaactgag

SEQ ID NO: 40872 - DNA, 16 bp, Artificial Sequence
  synthetic [barcode part1]
taggtcgatcaccagt

SEQ ID NO: 40873 - DNA, 16 bp, Artificial Sequence
  synthetic [barcode part1]
cctgtatccgagtcgt

SEQ ID NO: 40874 - DNA, 16 bp, Artificial Sequence
  synthetic [barcode part1]
tctctcgccgtacaag

SEQ ID NO: 40875 - DNA, 16 bp, Artificial Sequence
  synthetic [barcode part1]
gagagacgcaactacc

SEQ ID NO: 40876 - DNA, 16 bp, Artificial Sequence
  synthetic [barcode part1]
gaaggtaggatcgcct

SEQ ID NO: 40877 - DNA, 16 bp, Artificial Sequence
  synthetic [barcode part1]
gcaattgtagtcgcac

SEQ ID NO: 40878 - DNA, 16 bp, Artificial Sequence
  synthetic [barcode part1]
caatcttactgtgtgc

SEQ ID NO: 40879 - DNA, 16 bp, Artificial Sequence
  synthetic [barcode part1]
acggtgattgttaccg

SEQ ID NO: 40880 - DNA, 16 bp, Artificial Sequence
  synthetic [barcode part1]
cactgtagaagaggag

SEQ ID NO: 40881 - DNA, 16 bp, Artificial Sequence
  synthetic [barcode part1]
agttatagaggccggc

SEQ ID NO: 40882 - DNA, 16 bp, Artificial Sequence
  synthetic [barcode part1]
tcagaggcagtaagag

SEQ ID NO: 40883 - DNA, 16 bp, Artificial Sequence
  synthetic [barcode part1]
tacacgttacgcgtag

SEQ ID NO: 40884 - DNA, 16 bp, Artificial Sequence
  synthetic [barcode part1]
tcggtaaggcacgaac

SEQ ID NO: 40885 - DNA, 16 bp, Artificial Sequence
  synthetic [barcode part1]
taactatcagaaggcg

SEQ ID NO: 40886 - DNA, 16 bp, Artificial Sequence
  synthetic [barcode part1]
atatcaggtgtggcct

SEQ ID NO: 40887 - DNA, 16 bp, Artificial Sequence
  synthetic [barcode part1]
acagaccagagaccgt

SEQ ID NO: 40888 - DNA, 16 bp, Artificial Sequence
  synthetic [barcode part1]
tctacttccacaacag

SEQ ID NO: 40889 - DNA, 16 bp, Artificial Sequence
  synthetic [barcode part1]
gccttcttgtgcagtg

SEQ ID NO: 40890 - DNA, 16 bp, Artificial Sequence
  synthetic [barcode part1]
aagaatcaccgtgtag

SEQ ID NO: 40891 - DNA, 16 bp, Artificial Sequence
  synthetic [barcode part1]
tggaatccgacgttac

SEQ ID NO: 40892 - DNA, 16 bp, Artificial Sequence
  synthetic [barcode part1]
caggacaataactgtg

SEQ ID NO: 40893 - DNA, 16 bp, Artificial Sequence
  synthetic [barcode part1]
acaagaaggagacacc

SEQ ID NO: 40894 - DNA, 16 bp, Artificial Sequence
  synthetic [barcode part1]
tatctacgacgagtgc

SEQ ID NO: 40895 - DNA, 16 bp, Artificial Sequence
  synthetic [barcode part1]
tcgtatctgccgaatt

SEQ ID NO: 40896 - DNA, 16 bp, Artificial Sequence
  synthetic [barcode part1]
acaactcactcctgcg

SEQ ID NO: 40897 - DNA, 16 bp, Artificial Sequence
  synthetic [barcode part1]
tacgtgtcagtgtcag

SEQ ID NO: 40898 - DNA, 16 bp, Artificial Sequence
  synthetic [barcode part1]
gtctaagtcgtagacc

SEQ ID NO: 40899 - DNA, 16 bp, Artificial Sequence
  synthetic [barcode part1]
cctcgtaacgtagaac

SEQ ID NO: 40900 - DNA, 16 bp, Artificial Sequence
  synthetic [barcode part1]
tctaccggcgtctaac

SEQ ID NO: 40901 - DNA, 16 bp, Artificial Sequence
  synthetic [barcode part1]
caggaccactaatcac

SEQ ID NO: 40902 - DNA, 16 bp, Artificial Sequence
  synthetic [barcode part1]
gaacgcctgtcacttc

SEQ ID NO: 40903 - DNA, 16 bp, Artificial Sequence
  synthetic [barcode part1]
gatacgtcctcttggc

SEQ ID NO: 40904 - DNA, 16 bp, Artificial Sequence
  synthetic [barcode part1]
tgcacagacgaggtgt

SEQ ID NO: 40905 - DNA, 16 bp, Artificial Sequence
  synthetic [barcode part1]
tagtcagagtcttggc

SEQ ID NO: 40906 - DNA, 16 bp, Artificial Sequence
  synthetic [barcode part1]
cgaacgcagagtaacc

SEQ ID NO: 40907 - DNA, 16 bp, Artificial Sequence
  synthetic [barcode part1]
cgagtagtctatccag

SEQ ID NO: 40908 - DNA, 16 bp, Artificial Sequence
  synthetic [barcode part1]
atacgtggtcgatcac

SEQ ID NO: 40909 - DNA, 16 bp, Artificial Sequence
  synthetic [barcode part1]
agtgtctatccttcag

SEQ ID NO: 40910 - DNA, 16 bp, Artificial Sequence
  synthetic [barcode part1]
aatccgtcagacgttg

SEQ ID NO: 40911 - DNA, 16 bp, Artificial Sequence
  synthetic [barcode part1]
aaccgcgagaaccaac

SEQ ID NO: 40912 - DNA, 16 bp, Artificial Sequence
  synthetic [barcode part1]
cagatcttccggatag

SEQ ID NO: 40913 - DNA, 16 bp, Artificial Sequence
  synthetic [barcode part1]
tataacactactcgcc

SEQ ID NO: 40914 - DNA, 16 bp, Artificial Sequence
  synthetic [barcode part1]
gacctcttgcgaactc

SEQ ID NO: 40915 - DNA, 16 bp, Artificial Sequence
  synthetic [barcode part1]
caacaggcgttacttg

SEQ ID NO: 40916 - DNA, 16 bp, Artificial Sequence
  synthetic [barcode part1]
agataggatctcgagt

SEQ ID NO: 40917 - DNA, 16 bp, Artificial Sequence
  synthetic [barcode part1]
gcgaagatcgaactgc

SEQ ID NO: 40918 - DNA, 16 bp, Artificial Sequence
  synthetic [barcode part1]
actcgcgtgacagaag

SEQ ID NO: 40919 - DNA, 16 bp, Artificial Sequence
  synthetic [barcode part1]
agtactgtgcagtacc

SEQ ID NO: 40920 - DNA, 16 bp, Artificial Sequence
  synthetic [barcode part1]
cgattcacctgacaag

SEQ ID NO: 40921 - DNA, 16 bp, Artificial Sequence
  synthetic [barcode part1]
gagttattgtctccgt

SEQ ID NO: 40922 - DNA, 16 bp, Artificial Sequence
  synthetic [barcode part1]
ccagattaactcggtg

SEQ ID NO: 40923 - DNA, 16 bp, Artificial Sequence
  synthetic [barcode part1]
cgtaatctggccttcg

SEQ ID NO: 40924 - DNA, 16 bp, Artificial Sequence
  synthetic [barcode part1]
agaatccggtgaatac

SEQ ID NO: 40925 - DNA, 16 bp, Artificial Sequence
  synthetic [barcode part1]
cagaaggttagaaggc

SEQ ID NO: 40926 - DNA, 16 bp, Artificial Sequence
  synthetic [barcode part1]
agtctgaagtctgacc

SEQ ID NO: 40927 - DNA, 16 bp, Artificial Sequence
  synthetic [barcode part1]
cctaattcctcctgac

SEQ ID NO: 40928 - DNA, 16 bp, Artificial Sequence
  synthetic [barcode part1]
acactgaagaacagtc

SEQ ID NO: 40929 - DNA, 16 bp, Artificial Sequence
  synthetic [barcode part1]
gaccttcgacctacac

SEQ ID NO: 40930 - DNA, 16 bp, Artificial Sequence
  synthetic [barcode part1]
tgattccaggaccagt

SEQ ID NO: 40931 - DNA, 16 bp, Artificial Sequence
  synthetic [barcode part1]
ccacgactacaatacg

SEQ ID NO: 40932 - DNA, 16 bp, Artificial Sequence
  synthetic [barcode part1]
acagtgtccaatcgac

SEQ ID NO: 40933 - DNA, 16 bp, Artificial Sequence
  synthetic [barcode part1]
tcgacagtggatcact

SEQ ID NO: 40934 - DNA, 16 bp, Artificial Sequence
  synthetic [barcode part1]
accaacggagttaagt

SEQ ID NO: 40935 - DNA, 16 bp, Artificial Sequence
  synthetic [barcode part1]
tagatacaccgagagt

SEQ ID NO: 40936 - DNA, 16 bp, Artificial Sequence
  synthetic [barcode part1]
tctatctacgacgccg

SEQ ID NO: 40937 - DNA, 16 bp, Artificial Sequence
  synthetic [barcode part1]
gtaggtgttatccgtg

SEQ ID NO: 40938 - DNA, 16 bp, Artificial Sequence
  synthetic [barcode part1]
atcgcgatagataggt

SEQ ID NO: 40939 - DNA, 16 bp, Artificial Sequence
  synthetic [barcode part1]
taataggcagacgccg

SEQ ID NO: 40940 - DNA, 16 bp, Artificial Sequence
  synthetic [barcode part1]
cgtggtatacttgtct

SEQ ID NO: 40941 - DNA, 16 bp, Artificial Sequence
  synthetic [barcode part1]
ttaggcggcggtaagt

SEQ ID NO: 40942 - DNA, 16 bp, Artificial Sequence
  synthetic [barcode part1]
taagaaggaccggaac

SEQ ID NO: 40943 - DNA, 16 bp, Artificial Sequence
  synthetic [barcode part1]
tcggtgaagactacct

SEQ ID NO: 40944 - DNA, 16 bp, Artificial Sequence
  synthetic [barcode part1]
gattcaggaggcgtac

SEQ ID NO: 40945 - DNA, 16 bp, Artificial Sequence
  synthetic [barcode part1]
acaggttacacttggc

SEQ ID NO: 40946 - DNA, 16 bp, Artificial Sequence
  synthetic [barcode part1]
tccgtgtggcctaatc

SEQ ID NO: 40947 - DNA, 16 bp, Artificial Sequence
  synthetic [barcode part1]
cggtgtcttatccgtg

SEQ ID NO: 40948 - DNA, 16 bp, Artificial Sequence
  synthetic [barcode part1]
tggtcctgcactgatc

SEQ ID NO: 40949 - DNA, 16 bp, Artificial Sequence
  synthetic [barcode part1]
acagattgagagtcgt

SEQ ID NO: 40950 - DNA, 16 bp, Artificial Sequence
  synthetic [barcode part1]
tgtgatctcaggtgtg

SEQ ID NO: 40951 - DNA, 16 bp, Artificial Sequence
  synthetic [barcode part1]
tacctgcggattctgc

SEQ ID NO: 40952 - DNA, 16 bp, Artificial Sequence
  synthetic [barcode part1]
cgacaattctcgtatc

SEQ ID NO: 40953 - DNA, 16 bp, Artificial Sequence
  synthetic [barcode part1]
taaggaactctctggc

SEQ ID NO: 40954 - DNA, 16 bp, Artificial Sequence
  synthetic [barcode part1]
cgcgttggttgtatag

SEQ ID NO: 40955 - DNA, 16 bp, Artificial Sequence
  synthetic [barcode part1]
actcagtgaggtatag

SEQ ID NO: 40956 - DNA, 16 bp, Artificial Sequence
  synthetic [barcode part1]
taaggtatatcggcag

SEQ ID NO: 40957 - DNA, 16 bp, Artificial Sequence
  synthetic [barcode part1]
actcacactagacgtg

SEQ ID NO: 40958 - DNA, 16 bp, Artificial Sequence
  synthetic [barcode part1]
aacggtccttctgcgt

SEQ ID NO: 40959 - DNA, 16 bp, Artificial Sequence
  synthetic [barcode part1]
tctgttgcgcgttggt

SEQ ID NO: 40960 - DNA, 16 bp, Artificial Sequence
  synthetic [barcode part1]
gaggactgtgtgtcag

SEQ ID NO: 40961 - DNA, 16 bp, Artificial Sequence
  synthetic [barcode part1]
cgtgtcgaatctctcg

SEQ ID NO: 40962 - DNA, 16 bp, Artificial Sequence
  synthetic [barcode part1]
taacgcagtgcctaac

SEQ ID NO: 40963 - DNA, 16 bp, Artificial Sequence
  synthetic [barcode part1]
taagtaggtccacctg

SEQ ID NO: 40964 - DNA, 16 bp, Artificial Sequence
  synthetic [barcode part1]
acgtcggactaaggac

SEQ ID NO: 40965 - DNA, 16 bp, Artificial Sequence
  synthetic [barcode part1]
cagaggataacgtatc

SEQ ID NO: 40966 - DNA, 16 bp, Artificial Sequence
  synthetic [barcode part1]
agtcggaatagtcgcg

SEQ ID NO: 40967 - DNA, 16 bp, Artificial Sequence
  synthetic [barcode part1]
cgacgacactattgac

SEQ ID NO: 40968 - DNA, 16 bp, Artificial Sequence
  synthetic [barcode part1]
gagacttagtgttgcc

SEQ ID NO: 40969 - DNA, 16 bp, Artificial Sequence
  synthetic [barcode part1]
atcgatcgactagtcg

SEQ ID NO: 40970 - DNA, 16 bp, Artificial Sequence
  synthetic [barcode part1]
cgtcactctactgttc

SEQ ID NO: 40971 - DNA, 16 bp, Artificial Sequence
  synthetic [barcode part1]
gatcgattgcagtacc

SEQ ID NO: 40972 - DNA, 16 bp, Artificial Sequence
  synthetic [barcode part1]
attcgacggtctagtg

SEQ ID NO: 40973 - DNA, 16 bp, Artificial Sequence
  synthetic [barcode part1]
acgaaggaggagtatc

SEQ ID NO: 40974 - DNA, 16 bp, Artificial Sequence
  synthetic [barcode part1]
gttgcggaatagatac

SEQ ID NO: 40975 - DNA, 16 bp, Artificial Sequence
  synthetic [barcode part1]
cacttagactagagag

SEQ ID NO: 40976 - DNA, 16 bp, Artificial Sequence
  synthetic [barcode part1]
accacggtaagtaggc

SEQ ID NO: 40977 - DNA, 16 bp, Artificial Sequence
  synthetic [barcode part1]
gattctctctccgact

SEQ ID NO: 40978 - DNA, 16 bp, Artificial Sequence
  synthetic [barcode part1]
tcttacagtgcggaac

SEQ ID NO: 40979 - DNA, 16 bp, Artificial Sequence
  synthetic [barcode part1]
tcaacgacaccgaatc

SEQ ID NO: 40980 - DNA, 16 bp, Artificial Sequence
  synthetic [barcode part1]
ataccacctcgtccag

SEQ ID NO: 40981 - DNA, 16 bp, Artificial Sequence
  synthetic [barcode part1]
aaggtctaacaccgtc

SEQ ID NO: 40982 - DNA, 16 bp, Artificial Sequence
  synthetic [barcode part1]
cactagttgcggttag

SEQ ID NO: 40983 - DNA, 16 bp, Artificial Sequence
  synthetic [barcode part1]
gattgaagttcgaacg

SEQ ID NO: 40984 - DNA, 16 bp, Artificial Sequence
  synthetic [barcode part1]
gtggagagaaggtatc

SEQ ID NO: 40985 - DNA, 16 bp, Artificial Sequence
  synthetic [barcode part1]
ttcggattatcggcag

SEQ ID NO: 40986 - DNA, 16 bp, Artificial Sequence
  synthetic [barcode part1]
cgtctggttgatacag

SEQ ID NO: 40987 - DNA, 16 bp, Artificial Sequence
  synthetic [barcode part1]
tactggtcgatcgtag

SEQ ID NO: 40988 - DNA, 16 bp, Artificial Sequence
  synthetic [barcode part1]
acctactgtagtgtct

SEQ ID NO: 40989 - DNA, 16 bp, Artificial Sequence
  synthetic [barcode part1]
aaggcggcagacactt

SEQ ID NO: 40990 - DNA, 16 bp, Artificial Sequence
  synthetic [barcode part1]
tccacaactgtgaacg

SEQ ID NO: 40991 - DNA, 16 bp, Artificial Sequence
  synthetic [barcode part1]
atacgacgcaccaatc

SEQ ID NO: 40992 - DNA, 16 bp, Artificial Sequence
  synthetic [barcode part1]
agtaggaatactcggt

SEQ ID NO: 40993 - DNA, 16 bp, Artificial Sequence
  synthetic [barcode part1]
agacttctcggagttg

SEQ ID NO: 40994 - DNA, 16 bp, Artificial Sequence
  synthetic [barcode part1]
gttcctgttacgttcc

SEQ ID NO: 40995 - DNA, 16 bp, Artificial Sequence
  synthetic [barcode part1]
gccacggtaagattct

SEQ ID NO: 40996 - DNA, 16 bp, Artificial Sequence
  synthetic [barcode part1]
acttactggcgtcacc

SEQ ID NO: 40997 - DNA, 16 bp, Artificial Sequence
  synthetic [barcode part1]
ccagttatacagtgcg

SEQ ID NO: 40998 - DNA, 16 bp, Artificial Sequence
  synthetic [barcode part1]
tggtgtacacgttgac

SEQ ID NO: 40999 - DNA, 16 bp, Artificial Sequence
  synthetic [barcode part1]
cactccacggatactc

SEQ ID NO: 41000 - DNA, 16 bp, Artificial Sequence
  synthetic [barcode part1]
ccacttcgaagtaacg

SEQ ID NO: 41001 - DNA, 16 bp, Artificial Sequence
  synthetic [barcode part1]
cacgatattatccgtc

SEQ ID NO: 41002 - DNA, 16 bp, Artificial Sequence
  synthetic [barcode part1]
cagttctgtactgact

SEQ ID NO: 41003 - DNA, 16 bp, Artificial Sequence
  synthetic [barcode part1]
agacaccgtgaatcct

SEQ ID NO: 41004 - DNA, 16 bp, Artificial Sequence
  synthetic [barcode part1]
cgacgtcgtaggtaag

SEQ ID NO: 41005 - DNA, 16 bp, Artificial Sequence
  synthetic [barcode part1]
aagttcggttcggatc

SEQ ID NO: 41006 - DNA, 16 bp, Artificial Sequence
  synthetic [barcode part1]
cagtgtagaaggccac

SEQ ID NO: 41007 - DNA, 16 bp, Artificial Sequence
  synthetic [barcode part1]
gtataatccggaagac

SEQ ID NO: 41008 - DNA, 16 bp, Artificial Sequence
  synthetic [barcode part1]
gattgacgactgatcc

SEQ ID NO: 41009 - DNA, 16 bp, Artificial Sequence
  synthetic [barcode part1]
actcctaggcaatctt

SEQ ID NO: 41010 - DNA, 16 bp, Artificial Sequence
  synthetic [barcode part1]
cgacctctgtggttgt

SEQ ID NO: 41011 - DNA, 16 bp, Artificial Sequence
  synthetic [barcode part1]
aatcgtatcttccggt

SEQ ID NO: 41012 - DNA, 16 bp, Artificial Sequence
  synthetic [barcode part1]
taagaaccaccggacg

SEQ ID NO: 41013 - DNA, 16 bp, Artificial Sequence
  synthetic [barcode part1]
tccgtattgcgaaggt

SEQ ID NO: 41014 - DNA, 16 bp, Artificial Sequence
  synthetic [barcode part1]
gaactaacgacgtgcg

SEQ ID NO: 41015 - DNA, 16 bp, Artificial Sequence
  synthetic [barcode part1]
tgagtaactcagagtg

SEQ ID NO: 41016 - DNA, 16 bp, Artificial Sequence
  synthetic [barcode part1]
aggttgtaacgcaggc

SEQ ID NO: 41017 - DNA, 16 bp, Artificial Sequence
  synthetic [barcode part1]
atccttgcgttaggtt

SEQ ID NO: 41018 - DNA, 16 bp, Artificial Sequence
  synthetic [barcode part1]
tctccttccttggaac

SEQ ID NO: 41019 - DNA, 16 bp, Artificial Sequence
  synthetic [barcode part1]
taggtcaagtctggtc

SEQ ID NO: 41020 - DNA, 16 bp, Artificial Sequence
  synthetic [barcode part1]
ttgacgacgtcctcac

SEQ ID NO: 41021 - DNA, 16 bp, Artificial Sequence
  synthetic [barcode part1]
ccgtcgataatccaag

SEQ ID NO: 41022 - DNA, 16 bp, Artificial Sequence
  synthetic [barcode part1]
tgccgtccagattcgt

SEQ ID NO: 41023 - DNA, 16 bp, Artificial Sequence
  synthetic [barcode part1]
gcaaccaccaaggagt

SEQ ID NO: 41024 - DNA, 16 bp, Artificial Sequence
  synthetic [barcode part1]
acgcaagtatcaggcg

SEQ ID NO: 41025 - DNA, 16 bp, Artificial Sequence
  synthetic [barcode part1]
cacggaatagtgaccg

SEQ ID NO: 41026 - DNA, 16 bp, Artificial Sequence
  synthetic [barcode part1]
actggtgacctctcgt

SEQ ID NO: 41027 - DNA, 16 bp, Artificial Sequence
  synthetic [barcode part1]
agtagaatataccggc

SEQ ID NO: 41028 - DNA, 16 bp, Artificial Sequence
  synthetic [barcode part1]
atctgttctgcgacgc

SEQ ID NO: 41029 - DNA, 16 bp, Artificial Sequence
  synthetic [barcode part1]
cgtgtagttcagttct

SEQ ID NO: 41030 - DNA, 16 bp, Artificial Sequence
  synthetic [barcode part1]
gaactactagaccacc

SEQ ID NO: 41031 - DNA, 16 bp, Artificial Sequence
  synthetic [barcode part1]
cggtaagtcgtgagtg

SEQ ID NO: 41032 - DNA, 16 bp, Artificial Sequence
  synthetic [barcode part1]
acttggtcgtacctcg

SEQ ID NO: 41033 - DNA, 16 bp, Artificial Sequence
  synthetic [barcode part1]
gttcctctggtcacag

SEQ ID NO: 41034 - DNA, 16 bp, Artificial Sequence
  synthetic [barcode part1]
tgtctcgtaggcactc

SEQ ID NO: 41035 - DNA, 16 bp, Artificial Sequence
  synthetic [barcode part1]
agagtcttccagaacc

SEQ ID NO: 41036 - DNA, 16 bp, Artificial Sequence
  synthetic [barcode part1]
gtcaaggaaggtcaag

SEQ ID NO: 41037 - DNA, 16 bp, Artificial Sequence
  synthetic [barcode part1]
ttgagtcgtacaagag

SEQ ID NO: 41038 - DNA, 16 bp, Artificial Sequence
  synthetic [barcode part1]
gtccgtggagataacg

SEQ ID NO: 41039 - DNA, 16 bp, Artificial Sequence
  synthetic [barcode part1]
agtacaacgaggacag

SEQ ID NO: 41040 - DNA, 16 bp, Artificial Sequence
  synthetic [barcode part1]
gccaggcgaattactt

SEQ ID NO: 41041 - DNA, 16 bp, Artificial Sequence
  synthetic [barcode part1]
aagtgccgccttgtct

SEQ ID NO: 41042 - DNA, 16 bp, Artificial Sequence
  synthetic [barcode part1]
cgcctcgcgaatattc

SEQ ID NO: 41043 - DNA, 16 bp, Artificial Sequence
  synthetic [barcode part1]
tggttcctgtagtcgc

SEQ ID NO: 41044 - DNA, 16 bp, Artificial Sequence
  synthetic [barcode part1]
tctcgaatatccactg

SEQ ID NO: 41045 - DNA, 16 bp, Artificial Sequence
  synthetic [barcode part1]
caataattgcagaggc

SEQ ID NO: 41046 - DNA, 16 bp, Artificial Sequence
  synthetic [barcode part1]
gaatattggtgagacc

SEQ ID NO: 41047 - DNA, 16 bp, Artificial Sequence
  synthetic [barcode part1]
tactgccacagagtac

SEQ ID NO: 41048 - DNA, 16 bp, Artificial Sequence
  synthetic [barcode part1]
cacgcgatagaggatc

SEQ ID NO: 41049 - DNA, 16 bp, Artificial Sequence
  synthetic [barcode part1]
tctggtacaagagtag

SEQ ID NO: 41050 - DNA, 16 bp, Artificial Sequence
  synthetic [barcode part1]
tacgttgagaaggttg

SEQ ID NO: 41051 - DNA, 16 bp, Artificial Sequence
  synthetic [barcode part1]
ccaacgacgaatcgtt

SEQ ID NO: 41052 - DNA, 16 bp, Artificial Sequence
  synthetic [barcode part1]
tgcgaatctgtagacc

SEQ ID NO: 41053 - DNA, 16 bp, Artificial Sequence
  synthetic [barcode part1]
gtgagttgaccgtatc

SEQ ID NO: 41054 - DNA, 16 bp, Artificial Sequence
  synthetic [barcode part1]
aatctctgcacaatcc

SEQ ID NO: 41055 - DNA, 16 bp, Artificial Sequence
  synthetic [barcode part1]
tgtactgacgtgtcag

SEQ ID NO: 41056 - DNA, 16 bp, Artificial Sequence
  synthetic [barcode part1]
gtcgacctcaattgag

SEQ ID NO: 41057 - DNA, 16 bp, Artificial Sequence
  synthetic [barcode part1]
gattcaatctccgtgt

SEQ ID NO: 41058 - DNA, 16 bp, Artificial Sequence
  synthetic [barcode part1]
tgagacggcagttacg

SEQ ID NO: 41059 - DNA, 16 bp, Artificial Sequence
  synthetic [barcode part1]
tcgaatccgtgtctcg

SEQ ID NO: 41060 - DNA, 16 bp, Artificial Sequence
  synthetic [barcode part1]
caacactgttcgcctg

SEQ ID NO: 41061 - DNA, 16 bp, Artificial Sequence
  synthetic [barcode part1]
tgttcgcaacgtcacc

SEQ ID NO: 41062 - DNA, 16 bp, Artificial Sequence
  synthetic [barcode part1]
cactcgtggtgttgtc

SEQ ID NO: 41063 - DNA, 16 bp, Artificial Sequence
  synthetic [barcode part1]
aacctcaggtggacag

SEQ ID NO: 41064 - DNA, 16 bp, Artificial Sequence
  synthetic [barcode part1]
gacacgagaactgtcg

SEQ ID NO: 41065 - DNA, 16 bp, Artificial Sequence
  synthetic [barcode part1]
tcacgcgagaagactg

SEQ ID NO: 41066 - DNA, 16 bp, Artificial Sequence
  synthetic [barcode part1]
tgttcagagtccacag

SEQ ID NO: 41067 - DNA, 16 bp, Artificial Sequence
  synthetic [barcode part1]
tgacaggacctgtgag

SEQ ID NO: 41068 - DNA, 16 bp, Artificial Sequence
  synthetic [barcode part1]
caagacgtcgtgcaag

SEQ ID NO: 41069 - DNA, 16 bp, Artificial Sequence
  synthetic [barcode part1]
gatccgacttcgtatt

SEQ ID NO: 41070 - DNA, 16 bp, Artificial Sequence
  synthetic [barcode part1]
ttaactcgttcgagtc

SEQ ID NO: 41071 - DNA, 16 bp, Artificial Sequence
  synthetic [barcode part1]
tgcctaattgaacgcg

SEQ ID NO: 41072 - DNA, 16 bp, Artificial Sequence
  synthetic [barcode part1]
gaacctagtctagacc

SEQ ID NO: 41073 - DNA, 16 bp, Artificial Sequence
  synthetic [barcode part1]
gagagtcctgaagaag

SEQ ID NO: 41074 - DNA, 16 bp, Artificial Sequence
  synthetic [barcode part1]
aggtctgtcgttgcct

SEQ ID NO: 41075 - DNA, 16 bp, Artificial Sequence
  synthetic [barcode part1]
ttctaacaccgtcctc

SEQ ID NO: 41076 - DNA, 16 bp, Artificial Sequence
  synthetic [barcode part1]
gtggtcagttggtact

SEQ ID NO: 41077 - DNA, 16 bp, Artificial Sequence
  synthetic [barcode part1]
gtctccttgatatacg

SEQ ID NO: 41078 - DNA, 16 bp, Artificial Sequence
  synthetic [barcode part1]
cagtacactggtacac

SEQ ID NO: 41079 - DNA, 16 bp, Artificial Sequence
  synthetic [barcode part1]
gtcttgaattgcggtg

SEQ ID NO: 41080 - DNA, 16 bp, Artificial Sequence
  synthetic [barcode part1]
ttgcctggagtcttgc

SEQ ID NO: 41081 - DNA, 16 bp, Artificial Sequence
  synthetic [barcode part1]
tgatcagttaaccggc

SEQ ID NO: 41082 - DNA, 16 bp, Artificial Sequence
  synthetic [barcode part1]
taacgcaccagtacac

SEQ ID NO: 41083 - DNA, 16 bp, Artificial Sequence
  synthetic [barcode part1]
taatcctcgacacgcc

SEQ ID NO: 41084 - DNA, 16 bp, Artificial Sequence
  synthetic [barcode part1]
tccgaggaagaagaac

SEQ ID NO: 41085 - DNA, 16 bp, Artificial Sequence
  synthetic [barcode part1]
caggtcacagtagtct

SEQ ID NO: 41086 - DNA, 16 bp, Artificial Sequence
  synthetic [barcode part1]
ccgattcttgttgtcc

SEQ ID NO: 41087 - DNA, 16 bp, Artificial Sequence
  synthetic [barcode part1]
agtaccttattccacg

SEQ ID NO: 41088 - DNA, 16 bp, Artificial Sequence
  synthetic [barcode part1]
tcagtagagacgtggc

SEQ ID NO: 41089 - DNA, 16 bp, Artificial Sequence
  synthetic [barcode part1]
ccttattgcgaattcg

SEQ ID NO: 41090 - DNA, 16 bp, Artificial Sequence
  synthetic [barcode part1]
gtagacttgtgagtcc

SEQ ID NO: 41091 - DNA, 16 bp, Artificial Sequence
  synthetic [barcode part1]
tactgagatcttcacc

SEQ ID NO: 41092 - DNA, 16 bp, Artificial Sequence
  synthetic [barcode part1]
tctggtcaatcaaggc

SEQ ID NO: 41093 - DNA, 16 bp, Artificial Sequence
  synthetic [barcode part1]
aggcctgatctagatc

SEQ ID NO: 41094 - DNA, 16 bp, Artificial Sequence
  synthetic [barcode part1]
cgattcttggttgtgt

SEQ ID NO: 41095 - DNA, 16 bp, Artificial Sequence
  synthetic [barcode part1]
tgacaatcggtgacct

SEQ ID NO: 41096 - DNA, 16 bp, Artificial Sequence
  synthetic [barcode part1]
ttgacgagacaactcc

SEQ ID NO: 41097 - DNA, 16 bp, Artificial Sequence
  synthetic [barcode part1]
tctccggatcgacact

SEQ ID NO: 41098 - DNA, 16 bp, Artificial Sequence
  synthetic [barcode part1]
gcgacactgtgatatc

SEQ ID NO: 41099 - DNA, 16 bp, Artificial Sequence
  synthetic [barcode part1]
tggtgttggtagatag

SEQ ID NO: 41100 - DNA, 16 bp, Artificial Sequence
  synthetic [barcode part1]
tcttcctgtcgattgc

SEQ ID NO: 41101 - DNA, 16 bp, Artificial Sequence
  synthetic [barcode part1]
tctctggcgacgtatc

SEQ ID NO: 41102 - DNA, 16 bp, Artificial Sequence
  synthetic [barcode part1]
tgagacgtctgcagag

SEQ ID NO: 41103 - DNA, 16 bp, Artificial Sequence
  synthetic [barcode part1]
gcagaaggattgtcgc

SEQ ID NO: 41104 - DNA, 16 bp, Artificial Sequence
  synthetic [barcode part1]
agtgcgtctctccagt

SEQ ID NO: 41105 - DNA, 16 bp, Artificial Sequence
  synthetic [barcode part1]
gaacttgtaccttacc

SEQ ID NO: 41106 - DNA, 16 bp, Artificial Sequence
  synthetic [barcode part1]
ccaaggtccacctact

SEQ ID NO: 41107 - DNA, 16 bp, Artificial Sequence
  synthetic [barcode part1]
gtggacaacagacaag

SEQ ID NO: 41108 - DNA, 16 bp, Artificial Sequence
  synthetic [barcode part1]
aactcctgtatctggt

SEQ ID NO: 41109 - DNA, 16 bp, Artificial Sequence
  synthetic [barcode part1]
gtgacttcttacgttg

SEQ ID NO: 41110 - DNA, 16 bp, Artificial Sequence
  synthetic [barcode part1]
caaccgaccagaactt

SEQ ID NO: 41111 - DNA, 16 bp, Artificial Sequence
  synthetic [barcode part1]
tcgatccacctcttac

SEQ ID NO: 41112 - DNA, 16 bp, Artificial Sequence
  synthetic [barcode part1]
ttctgcaagtcgccgt

SEQ ID NO: 41113 - DNA, 16 bp, Artificial Sequence
  synthetic [barcode part1]
aaggaaggagaccttg

SEQ ID NO: 41114 - DNA, 16 bp, Artificial Sequence
  synthetic [barcode part1]
caacgattgacgactc

SEQ ID NO: 41115 - DNA, 16 bp, Artificial Sequence
  synthetic [barcode part1]
gttcgaagtagacctc

SEQ ID NO: 41116 - DNA, 16 bp, Artificial Sequence
  synthetic [barcode part1]
tgtcctgtgttgtctc

SEQ ID NO: 41117 - DNA, 16 bp, Artificial Sequence
  synthetic [barcode part1]
ttcggttctccagtct

SEQ ID NO: 41118 - DNA, 16 bp, Artificial Sequence
  synthetic [barcode part1]
acttgacctccgtgtg

SEQ ID NO: 41119 - DNA, 16 bp, Artificial Sequence
  synthetic [barcode part1]
tcaacgtggaggatcg

SEQ ID NO: 41120 - DNA, 16 bp, Artificial Sequence
  synthetic [barcode part1]
tcaacttgcaaggtgc

SEQ ID NO: 41121 - DNA, 16 bp, Artificial Sequence
  synthetic [barcode part1]
cgttgttagacacctt

SEQ ID NO: 41122 - DNA, 16 bp, Artificial Sequence
  synthetic [barcode part1]
ttgcacctaggtcgtc

SEQ ID NO: 41123 - DNA, 16 bp, Artificial Sequence
  synthetic [barcode part1]
aggattctggatagac

SEQ ID NO: 41124 - DNA, 16 bp, Artificial Sequence
  synthetic [barcode part1]
gatcttgacggtactg

SEQ ID NO: 41125 - DNA, 16 bp, Artificial Sequence
  synthetic [barcode part1]
tatctaacggttctcg

SEQ ID NO: 41126 - DNA, 16 bp, Artificial Sequence
  synthetic [barcode part1]
cgtagatcctaccacc

SEQ ID NO: 41127 - DNA, 16 bp, Artificial Sequence
  synthetic [barcode part1]
taggacttggtcagtc

SEQ ID NO: 41128 - DNA, 16 bp, Artificial Sequence
  synthetic [barcode part1]
gcgcagtaagaggttc

SEQ ID NO: 41129 - DNA, 16 bp, Artificial Sequence
  synthetic [barcode part1]
gataaccgccgttaac

SEQ ID NO: 41130 - DNA, 16 bp, Artificial Sequence
  synthetic [barcode part1]
aagaccgtgatctctg

SEQ ID NO: 41131 - DNA, 16 bp, Artificial Sequence
  synthetic [barcode part1]
tgtcctctcttacgtg

SEQ ID NO: 41132 - DNA, 16 bp, Artificial Sequence
  synthetic [barcode part1]
tctgaactccgactcg

SEQ ID NO: 41133 - DNA, 16 bp, Artificial Sequence
  synthetic [barcode part1]
taccactatccaggtt

SEQ ID NO: 41134 - DNA, 16 bp, Artificial Sequence
  synthetic [barcode part1]
gtcgcaggataggtac

SEQ ID NO: 41135 - DNA, 16 bp, Artificial Sequence
  synthetic [barcode part1]
acgagaactaggccgt

SEQ ID NO: 41136 - DNA, 16 bp, Artificial Sequence
  synthetic [barcode part1]
gacttactggacactg

SEQ ID NO: 41137 - DNA, 16 bp, Artificial Sequence
  synthetic [barcode part1]
cctaaggatcaaccgt

SEQ ID NO: 41138 - DNA, 16 bp, Artificial Sequence
  synthetic [barcode part1]
taacctcactgcgcgt

SEQ ID NO: 41139 - DNA, 16 bp, Artificial Sequence
  synthetic [barcode part1]
ccactcgataacactt

SEQ ID NO: 41140 - DNA, 16 bp, Artificial Sequence
  synthetic [barcode part1]
aacggcaacctacgag

SEQ ID NO: 41141 - DNA, 16 bp, Artificial Sequence
  synthetic [barcode part1]
gtattatcaggtggag

SEQ ID NO: 41142 - DNA, 16 bp, Artificial Sequence
  synthetic [barcode part1]
tcttggaggtaagtag

SEQ ID NO: 41143 - DNA, 16 bp, Artificial Sequence
  synthetic [barcode part1]
cctgtcggcacaatct

SEQ ID NO: 41144 - DNA, 16 bp, Artificial Sequence
  synthetic [barcode part1]
gttatctcaccgttcc

SEQ ID NO: 41145 - DNA, 16 bp, Artificial Sequence
  synthetic [barcode part1]
aaccgcaacgccaatt

SEQ ID NO: 41146 - DNA, 16 bp, Artificial Sequence
  synthetic [barcode part1]
gtgttgatctccgacc

SEQ ID NO: 41147 - DNA, 16 bp, Artificial Sequence
  synthetic [barcode part1]
tacgcaattgtcgttc

SEQ ID NO: 41148 - DNA, 16 bp, Artificial Sequence
  synthetic [barcode part1]
ttgccgtgtagtgaac

SEQ ID NO: 41149 - DNA, 16 bp, Artificial Sequence
  synthetic [barcode part1]
tacaagaagtctggtg

SEQ ID NO: 41150 - DNA, 16 bp, Artificial Sequence
  synthetic [barcode part1]
tctccagatcaatacc

SEQ ID NO: 41151 - DNA, 16 bp, Artificial Sequence
  synthetic [barcode part1]
ttcggcgtctatattg

SEQ ID NO: 41152 - DNA, 16 bp, Artificial Sequence
  synthetic [barcode part1]
gtggtattccttctcc

SEQ ID NO: 41153 - DNA, 16 bp, Artificial Sequence
  synthetic [barcode part1]
tcgtaggtctacgagt

SEQ ID NO: 41154 - DNA, 16 bp, Artificial Sequence
  synthetic [barcode part1]
cgtactaggtccttcg

SEQ ID NO: 41155 - DNA, 16 bp, Artificial Sequence
  synthetic [barcode part1]
tcttccgacagttgcg

SEQ ID NO: 41156 - DNA, 16 bp, Artificial Sequence
  synthetic [barcode part1]
gtcgtctgatagagtc

SEQ ID NO: 41157 - DNA, 16 bp, Artificial Sequence
  synthetic [barcode part1]
taactggtctctctcc

SEQ ID NO: 41158 - DNA, 16 bp, Artificial Sequence
  synthetic [barcode part1]
ttctgccagacctgtg

SEQ ID NO: 41159 - DNA, 16 bp, Artificial Sequence
  synthetic [barcode part1]
cagaggaataccaatc

SEQ ID NO: 41160 - DNA, 16 bp, Artificial Sequence
  synthetic [barcode part1]
atcacctctactccgt

SEQ ID NO: 41161 - DNA, 16 bp, Artificial Sequence
  synthetic [barcode part1]
tgccggagatacgaac

SEQ ID NO: 41162 - DNA, 16 bp, Artificial Sequence
  synthetic [barcode part1]
tgtacttgaacgtggc

SEQ ID NO: 41163 - DNA, 16 bp, Artificial Sequence
  synthetic [barcode part1]
gttgtcagatctgacg

SEQ ID NO: 41164 - DNA, 16 bp, Artificial Sequence
  synthetic [barcode part1]
tctatctggtaggcag

SEQ ID NO: 41165 - DNA, 16 bp, Artificial Sequence
  synthetic [barcode part1]
tatcttccgacctaag

SEQ ID NO: 41166 - DNA, 16 bp, Artificial Sequence
  synthetic [barcode part1]
actcacttctgtccgt

SEQ ID NO: 41167 - DNA, 16 bp, Artificial Sequence
  synthetic [barcode part1]
aacgtaacgccgaacg

SEQ ID NO: 41168 - DNA, 16 bp, Artificial Sequence
  synthetic [barcode part1]
tcaacaccagtacgtg

SEQ ID NO: 41169 - DNA, 16 bp, Artificial Sequence
  synthetic [barcode part1]
tgatcagtggtatcgc

SEQ ID NO: 41170 - DNA, 16 bp, Artificial Sequence
  synthetic [barcode part1]
tagtgaccgatctgac

SEQ ID NO: 41171 - DNA, 16 bp, Artificial Sequence
  synthetic [barcode part1]
gcggtgttataacacc

SEQ ID NO: 41172 - DNA, 16 bp, Artificial Sequence
  synthetic [barcode part1]
agtggaatcaacacgt

SEQ ID NO: 41173 - DNA, 16 bp, Artificial Sequence
  synthetic [barcode part1]
actggaccgttaggtt

SEQ ID NO: 41174 - DNA, 16 bp, Artificial Sequence
  synthetic [barcode part1]
attcggtctggatcag

SEQ ID NO: 41175 - DNA, 16 bp, Artificial Sequence
  synthetic [barcode part1]
aagatagacctgcaac

SEQ ID NO: 41176 - DNA, 16 bp, Artificial Sequence
  synthetic [barcode part1]
cggcgtaagaacaacc

SEQ ID NO: 41177 - DNA, 16 bp, Artificial Sequence
  synthetic [barcode part1]
gtcgatacttggcctc

SEQ ID NO: 41178 - DNA, 16 bp, Artificial Sequence
  synthetic [barcode part1]
tcaggtagacaaggcc

SEQ ID NO: 41179 - DNA, 16 bp, Artificial Sequence
  synthetic [barcode part1]
tgttgtgtgcaacgtg

SEQ ID NO: 41180 - DNA, 16 bp, Artificial Sequence
  synthetic [barcode part1]
tcgcctgatctcaggt

SEQ ID NO: 41181 - DNA, 16 bp, Artificial Sequence
  synthetic [barcode part1]
accgcagataggtgac

SEQ ID NO: 41182 - DNA, 16 bp, Artificial Sequence
  synthetic [barcode part1]
aggacactcttgtacg

SEQ ID NO: 41183 - DNA, 16 bp, Artificial Sequence
  synthetic [barcode part1]
cctaccactgaacgtc

SEQ ID NO: 41184 - DNA, 16 bp, Artificial Sequence
  synthetic [barcode part1]
tgttggatactcttgc

SEQ ID NO: 41185 - DNA, 16 bp, Artificial Sequence
  synthetic [barcode part1]
gtgtcggccttattgc

SEQ ID NO: 41186 - DNA, 16 bp, Artificial Sequence
  synthetic [barcode part1]
gttcttactcggtaac

SEQ ID NO: 41187 - DNA, 16 bp, Artificial Sequence
  synthetic [barcode part1]
taacaccgaacaagtg

SEQ ID NO: 41188 - DNA, 16 bp, Artificial Sequence
  synthetic [barcode part1]
actcgttctcagaact

SEQ ID NO: 41189 - DNA, 16 bp, Artificial Sequence
  synthetic [barcode part1]
tcggattaccgaatcg

SEQ ID NO: 41190 - DNA, 16 bp, Artificial Sequence
  synthetic [barcode part1]
cgttgaggccttcgtt

SEQ ID NO: 41191 - DNA, 16 bp, Artificial Sequence
  synthetic [barcode part1]
gtctcgtaccttctac

SEQ ID NO: 41192 - DNA, 16 bp, Artificial Sequence
  synthetic [barcode part1]
tcagagtggatcctac

SEQ ID NO: 41193 - DNA, 16 bp, Artificial Sequence
  synthetic [barcode part1]
taggtaacttggagtg

SEQ ID NO: 41194 - DNA, 16 bp, Artificial Sequence
  synthetic [barcode part1]
gagaacacactgaact

SEQ ID NO: 41195 - DNA, 16 bp, Artificial Sequence
  synthetic [barcode part1]
ccggttggttgattag

SEQ ID NO: 41196 - DNA, 16 bp, Artificial Sequence
  synthetic [barcode part1]
accttcgacaatctac

SEQ ID NO: 41197 - DNA, 16 bp, Artificial Sequence
  synthetic [barcode part1]
gttgacaacgaagtac

SEQ ID NO: 41198 - DNA, 16 bp, Artificial Sequence
  synthetic [barcode part1]
agtcgcgactgatatc

SEQ ID NO: 41199 - DNA, 16 bp, Artificial Sequence
  synthetic [barcode part1]
gataccttgtcgacag

SEQ ID NO: 41200 - DNA, 16 bp, Artificial Sequence
  synthetic [barcode part1]
tagtacctgtctactg

SEQ ID NO: 41201 - DNA, 16 bp, Artificial Sequence
  synthetic [barcode part1]
gatatcgaccaaccac

SEQ ID NO: 41202 - DNA, 16 bp, Artificial Sequence
  synthetic [barcode part1]
ttgagtgagtgtctgc

SEQ ID NO: 41203 - DNA, 16 bp, Artificial Sequence
  synthetic [barcode part1]
tgatacgcgtattggc

SEQ ID NO: 41204 - DNA, 16 bp, Artificial Sequence
  synthetic [barcode part1]
cgttaacggaagaccg

SEQ ID NO: 41205 - DNA, 16 bp, Artificial Sequence
  synthetic [barcode part1]
gatctgtcgagtgttg

SEQ ID NO: 41206 - DNA, 16 bp, Artificial Sequence
  synthetic [barcode part1]
actggcgtacttcacc

SEQ ID NO: 41207 - DNA, 16 bp, Artificial Sequence
  synthetic [barcode part1]
cctagtctggttatac

SEQ ID NO: 41208 - DNA, 16 bp, Artificial Sequence
  synthetic [barcode part1]
acaacctctgttggag

SEQ ID NO: 41209 - DNA, 16 bp, Artificial Sequence
  synthetic [barcode part1]
gtcgcgtactacttcg

SEQ ID NO: 41210 - DNA, 16 bp, Artificial Sequence
  synthetic [barcode part1]
atcgttgcaactcgag

SEQ ID NO: 41211 - DNA, 16 bp, Artificial Sequence
  synthetic [barcode part1]
acaactggttgcacac

SEQ ID NO: 41212 - DNA, 16 bp, Artificial Sequence
  synthetic [barcode part1]
caggaacaataatccg

SEQ ID NO: 41213 - DNA, 16 bp, Artificial Sequence
  synthetic [barcode part1]
acaactggttggtacc

SEQ ID NO: 41214 - DNA, 16 bp, Artificial Sequence
  synthetic [barcode part1]
cgagtagacagtattg

SEQ ID NO: 41215 - DNA, 16 bp, Artificial Sequence
  synthetic [barcode part1]
gtaaggacgacttagt

SEQ ID NO: 41216 - DNA, 16 bp, Artificial Sequence
  synthetic [barcode part1]
gtgaggtgaacctgtg

SEQ ID NO: 41217 - DNA, 16 bp, Artificial Sequence
  synthetic [barcode part1]
ccagtaacactctcgc

SEQ ID NO: 41218 - DNA, 16 bp, Artificial Sequence
  synthetic [barcode part1]
tctgtgagacactcag

SEQ ID NO: 41219 - DNA, 16 bp, Artificial Sequence
  synthetic [barcode part1]
cacttgatctccggtg

SEQ ID NO: 41220 - DNA, 16 bp, Artificial Sequence
  synthetic [barcode part1]
ttgacagtccgcgttc

SEQ ID NO: 41221 - DNA, 16 bp, Artificial Sequence
  synthetic [barcode part1]
tgtaccttcactgagt

SEQ ID NO: 41222 - DNA, 16 bp, Artificial Sequence
  synthetic [barcode part1]
cactactcagaggact

SEQ ID NO: 41223 - DNA, 16 bp, Artificial Sequence
  synthetic [barcode part1]
aacgtcaactgtggtc

SEQ ID NO: 41224 - DNA, 16 bp, Artificial Sequence
  synthetic [barcode part1]
ttgtctgatccgcctt

SEQ ID NO: 41225 - DNA, 16 bp, Artificial Sequence
  synthetic [barcode part1]
actcaacactgtcgag

SEQ ID NO: 41226 - DNA, 16 bp, Artificial Sequence
  synthetic [barcode part1]
agaccaggtatatcag

SEQ ID NO: 41227 - DNA, 16 bp, Artificial Sequence
  synthetic [barcode part1]
gtacgttcgttgacag

SEQ ID NO: 41228 - DNA, 16 bp, Artificial Sequence
  synthetic [barcode part1]
tgtcctgttgttccac

SEQ ID NO: 41229 - DNA, 16 bp, Artificial Sequence
  synthetic [barcode part1]
gtgacgaacaggatag

SEQ ID NO: 41230 - DNA, 16 bp, Artificial Sequence
  synthetic [barcode part1]
ttgtccaagatctcgt

SEQ ID NO: 41231 - DNA, 16 bp, Artificial Sequence
  synthetic [barcode part1]
cgtacaatcacacgac

SEQ ID NO: 41232 - DNA, 16 bp, Artificial Sequence
  synthetic [barcode part1]
actgcggattcgtctc

SEQ ID NO: 41233 - DNA, 16 bp, Artificial Sequence
  synthetic [barcode part1]
taccttatccgtcacc

SEQ ID NO: 41234 - DNA, 16 bp, Artificial Sequence
  synthetic [barcode part1]
tctcgtcgcctgtaag

SEQ ID NO: 41235 - DNA, 16 bp, Artificial Sequence
  synthetic [barcode part1]
cctaactacgccgact

SEQ ID NO: 41236 - DNA, 16 bp, Artificial Sequence
  synthetic [barcode part1]
ccaccttcaatccttg

SEQ ID NO: 41237 - DNA, 16 bp, Artificial Sequence
  synthetic [barcode part1]
gcaccgttaggtagag

SEQ ID NO: 41238 - DNA, 16 bp, Artificial Sequence
  synthetic [barcode part1]
gttagacagtgacctc

SEQ ID NO: 41239 - DNA, 16 bp, Artificial Sequence
  synthetic [barcode part1]
acgcacgagttctaac

SEQ ID NO: 41240 - DNA, 16 bp, Artificial Sequence
  synthetic [barcode part1]
gacgaggttggtacgt

SEQ ID NO: 41241 - DNA, 16 bp, Artificial Sequence
  synthetic [barcode part1]
gacttccgcgtaatcc

SEQ ID NO: 41242 - DNA, 16 bp, Artificial Sequence
  synthetic [barcode part1]
tctatacggaagtgcc

SEQ ID NO: 41243 - DNA, 16 bp, Artificial Sequence
  synthetic [barcode part1]
atccgagtcgtcctgt

SEQ ID NO: 41244 - DNA, 16 bp, Artificial Sequence
  synthetic [barcode part1]
tggtcctcttcctaac

SEQ ID NO: 41245 - DNA, 16 bp, Artificial Sequence
  synthetic [barcode part1]
cggaggaatactagtt

SEQ ID NO: 41246 - DNA, 16 bp, Artificial Sequence
  synthetic [barcode part1]
gtatcgtagataggtg

SEQ ID NO: 41247 - DNA, 16 bp, Artificial Sequence
  synthetic [barcode part1]
acgttaccaagatccg

SEQ ID NO: 41248 - DNA, 16 bp, Artificial Sequence
  synthetic [barcode part1]
agaaccggtgcaatcg

SEQ ID NO: 41249 - DNA, 16 bp, Artificial Sequence
  synthetic [barcode part1]
ccgcagtactgattag

SEQ ID NO: 41250 - DNA, 16 bp, Artificial Sequence
  synthetic [barcode part1]
ccggcaagagtacaac

SEQ ID NO: 41251 - DNA, 16 bp, Artificial Sequence
  synthetic [barcode part1]
agtcaatacgccgtgt

SEQ ID NO: 41252 - DNA, 16 bp, Artificial Sequence
  synthetic [barcode part1]
acttcgcgaactgaac

SEQ ID NO: 41253 - DNA, 16 bp, Artificial Sequence
  synthetic [barcode part1]
accttagtctccttcg

SEQ ID NO: 41254 - DNA, 16 bp, Artificial Sequence
  synthetic [barcode part1]
attggaacgtgtagtg

SEQ ID NO: 41255 - DNA, 16 bp, Artificial Sequence
  synthetic [barcode part1]
tggacaccaacctcct

SEQ ID NO: 41256 - DNA, 16 bp, Artificial Sequence
  synthetic [barcode part1]
cgtattcggatcactt

SEQ ID NO: 41257 - DNA, 16 bp, Artificial Sequence
  synthetic [barcode part1]
gtcaacggcaactgtt

SEQ ID NO: 41258 - DNA, 16 bp, Artificial Sequence
  synthetic [barcode part1]
aacggtcaactgtcgt

SEQ ID NO: 41259 - DNA, 16 bp, Artificial Sequence
  synthetic [barcode part1]
gatcttgttatccgtg

SEQ ID NO: 41260 - DNA, 16 bp, Artificial Sequence
  synthetic [barcode part1]
tgcaactgccacttcg

SEQ ID NO: 41261 - DNA, 16 bp, Artificial Sequence
  synthetic [barcode part1]
tgtcggcggagaattg

SEQ ID NO: 41262 - DNA, 16 bp, Artificial Sequence
  synthetic [barcode part1]
ataccaggtgcaatcc

SEQ ID NO: 41263 - DNA, 16 bp, Artificial Sequence
  synthetic [barcode part1]
attgtggaagtgaacc

SEQ ID NO: 41264 - DNA, 16 bp, Artificial Sequence
  synthetic [barcode part1]
tcgagtggcctcactt

SEQ ID NO: 41265 - DNA, 16 bp, Artificial Sequence
  synthetic [barcode part1]
attcgttcgttgtgac

SEQ ID NO: 41266 - DNA, 16 bp, Artificial Sequence
  synthetic [barcode part1]
gcgacgttatagtacc

SEQ ID NO: 41267 - DNA, 16 bp, Artificial Sequence
  synthetic [barcode part1]
accttacggtatacct

SEQ ID NO: 41268 - DNA, 16 bp, Artificial Sequence
  synthetic [barcode part1]
acgtatcgcaatcgtg

SEQ ID NO: 41269 - DNA, 16 bp, Artificial Sequence
  synthetic [barcode part1]
gagaggttggacctac

SEQ ID NO: 41270 - DNA, 16 bp, Artificial Sequence
  synthetic [barcode part1]
ttcctcgattcctcag

SEQ ID NO: 41271 - DNA, 16 bp, Artificial Sequence
  synthetic [barcode part1]
tcacttgcgaggcctt

SEQ ID NO: 41272 - DNA, 16 bp, Artificial Sequence
  synthetic [barcode part1]
ttgttaccgtctagac

SEQ ID NO: 41273 - DNA, 16 bp, Artificial Sequence
  synthetic [barcode part1]
atagtagacagtcgtg

SEQ ID NO: 41274 - DNA, 16 bp, Artificial Sequence
  synthetic [barcode part1]
tattcgtgacggacac

SEQ ID NO: 41275 - DNA, 16 bp, Artificial Sequence
  synthetic [barcode part1]
tgacggattgcgagtg

SEQ ID NO: 41276 - DNA, 16 bp, Artificial Sequence
  synthetic [barcode part1]
atagtaggacacgccg

SEQ ID NO: 41277 - DNA, 16 bp, Artificial Sequence
  synthetic [barcode part1]
agtagtactcactgcg

SEQ ID NO: 41278 - DNA, 16 bp, Artificial Sequence
  synthetic [barcode part1]
ttcaatcaccggcgtc

SEQ ID NO: 41279 - DNA, 16 bp, Artificial Sequence
  synthetic [barcode part1]
cgtaacgatctacctt

SEQ ID NO: 41280 - DNA, 16 bp, Artificial Sequence
  synthetic [barcode part1]
caagactgatcgactc

SEQ ID NO: 41281 - DNA, 16 bp, Artificial Sequence
  synthetic [barcode part1]
taaccacagactagag

SEQ ID NO: 41282 - DNA, 16 bp, Artificial Sequence
  synthetic [barcode part1]
gtctgaagtggcgaac

SEQ ID NO: 41283 - DNA, 16 bp, Artificial Sequence
  synthetic [barcode part1]
gcagacctagtaaggc

SEQ ID NO: 41284 - DNA, 16 bp, Artificial Sequence
  synthetic [barcode part1]
gataccggcgtatact

SEQ ID NO: 41285 - DNA, 16 bp, Artificial Sequence
  synthetic [barcode part1]
tcctaacctctcggtt

SEQ ID NO: 41286 - DNA, 16 bp, Artificial Sequence
  synthetic [barcode part1]
acacgagacaagagtg

SEQ ID NO: 41287 - DNA, 16 bp, Artificial Sequence
  synthetic [barcode part1]
gtactacgtctgcctg

SEQ ID NO: 41288 - DNA, 16 bp, Artificial Sequence
  synthetic [barcode part1]
cctgtcacgtattaac

SEQ ID NO: 41289 - DNA, 16 bp, Artificial Sequence
  synthetic [barcode part1]
cctcctagtaagacag

SEQ ID NO: 41290 - DNA, 16 bp, Artificial Sequence
  synthetic [barcode part1]
cacaccgtcaatctcg

SEQ ID NO: 41291 - DNA, 16 bp, Artificial Sequence
  synthetic [barcode part1]
tctcagttcaggtact

SEQ ID NO: 41292 - DNA, 16 bp, Artificial Sequence
  synthetic [barcode part1]
ttgatcttcgccactc

SEQ ID NO: 41293 - DNA, 16 bp, Artificial Sequence
  synthetic [barcode part1]
tggtgccgcaatattg

SEQ ID NO: 41294 - DNA, 16 bp, Artificial Sequence
  synthetic [barcode part1]
tacggtattcaaggcc

SEQ ID NO: 41295 - DNA, 16 bp, Artificial Sequence
  synthetic [barcode part1]
caccactctcaacttc

SEQ ID NO: 41296 - DNA, 16 bp, Artificial Sequence
  synthetic [barcode part1]
ccaagtgcaccactct

SEQ ID NO: 41297 - DNA, 16 bp, Artificial Sequence
  synthetic [barcode part1]
tataatacgtccgcct

SEQ ID NO: 41298 - DNA, 16 bp, Artificial Sequence
  synthetic [barcode part1]
tctgaggagaagaggt

SEQ ID NO: 41299 - DNA, 16 bp, Artificial Sequence
  synthetic [barcode part1]
acgcctgtctatcacg

SEQ ID NO: 41300 - DNA, 16 bp, Artificial Sequence
  synthetic [barcode part1]
accgaatatccttacc

SEQ ID NO: 41301 - DNA, 16 bp, Artificial Sequence
  synthetic [barcode part1]
gaggaacacgaagtac

SEQ ID NO: 41302 - DNA, 16 bp, Artificial Sequence
  synthetic [barcode part1]
tctcaccttcaggcag

SEQ ID NO: 41303 - DNA, 16 bp, Artificial Sequence
  synthetic [barcode part1]
ccttggcactattcct

SEQ ID NO: 41304 - DNA, 16 bp, Artificial Sequence
  synthetic [barcode part1]
cactagtattgcgcag

SEQ ID NO: 41305 - DNA, 16 bp, Artificial Sequence
  synthetic [barcode part1]
cgatcgatacggtact

SEQ ID NO: 41306 - DNA, 16 bp, Artificial Sequence
  synthetic [barcode part1]
caattggaccaatcgc

SEQ ID NO: 41307 - DNA, 16 bp, Artificial Sequence
  synthetic [barcode part1]
tcgtgaacggacttac

SEQ ID NO: 41308 - DNA, 16 bp, Artificial Sequence
  synthetic [barcode part1]
tgaacgtgtcacctcc

SEQ ID NO: 41309 - DNA, 16 bp, Artificial Sequence
  synthetic [barcode part1]
gacagtgacgaacctg

SEQ ID NO: 41310 - DNA, 16 bp, Artificial Sequence
  synthetic [barcode part1]
aggagtaatagtccgt

SEQ ID NO: 41311 - DNA, 16 bp, Artificial Sequence
  synthetic [barcode part1]
cgacctggaacgtaag

SEQ ID NO: 41312 - DNA, 16 bp, Artificial Sequence
  synthetic [barcode part1]
cctgccacaatcttct

SEQ ID NO: 41313 - DNA, 16 bp, Artificial Sequence
  synthetic [barcode part1]
cactgtaatacgtgcg

SEQ ID NO: 41314 - DNA, 16 bp, Artificial Sequence
  synthetic [barcode part1]
gagtacgtaatagtcg

SEQ ID NO: 41315 - DNA, 16 bp, Artificial Sequence
  synthetic [barcode part1]
gataccgtagtcggtt

SEQ ID NO: 41316 - DNA, 16 bp, Artificial Sequence
  synthetic [barcode part1]
acggttatcggccttc

SEQ ID NO: 41317 - DNA, 16 bp, Artificial Sequence
  synthetic [barcode part1]
gccagtataaggaact

SEQ ID NO: 41318 - DNA, 16 bp, Artificial Sequence
  synthetic [barcode part1]
ttcacagacgaacctg

SEQ ID NO: 41319 - DNA, 16 bp, Artificial Sequence
  synthetic [barcode part1]
gtcgtaagttctaggc

SEQ ID NO: 41320 - DNA, 16 bp, Artificial Sequence
  synthetic [barcode part1]
agtcagtaattccggc

SEQ ID NO: 41321 - DNA, 16 bp, Artificial Sequence
  synthetic [barcode part1]
cgacgtcaggtaagtg

SEQ ID NO: 41322 - DNA, 16 bp, Artificial Sequence
  synthetic [barcode part1]
cacagtagatagacac

SEQ ID NO: 41323 - DNA, 16 bp, Artificial Sequence
  synthetic [barcode part1]
aggaggtctatcactc

SEQ ID NO: 41324 - DNA, 16 bp, Artificial Sequence
  synthetic [barcode part1]
tgaaggcgtggtctag

SEQ ID NO: 41325 - DNA, 16 bp, Artificial Sequence
  synthetic [barcode part1]
gcacgtaagtcgatct

SEQ ID NO: 41326 - DNA, 16 bp, Artificial Sequence
  synthetic [barcode part1]
taacgacttccgcacc

SEQ ID NO: 41327 - DNA, 16 bp, Artificial Sequence
  synthetic [barcode part1]
tcctgtaaccgtcggt

SEQ ID NO: 41328 - DNA, 16 bp, Artificial Sequence
  synthetic [barcode part1]
tggcggttgataatcc

SEQ ID NO: 41329 - DNA, 16 bp, Artificial Sequence
  synthetic [barcode part1]
atccgagttcgaacgt

SEQ ID NO: 41330 - DNA, 16 bp, Artificial Sequence
  synthetic [barcode part1]
tgtcctataagtgcct

SEQ ID NO: 41331 - DNA, 16 bp, Artificial Sequence
  synthetic [barcode part1]
tcgtgtctgtcaggtc

SEQ ID NO: 41332 - DNA, 16 bp, Artificial Sequence
  synthetic [barcode part1]
aaccgataacctcgac

SEQ ID NO: 41333 - DNA, 16 bp, Artificial Sequence
  synthetic [barcode part1]
actcacctactcgttc

SEQ ID NO: 41334 - DNA, 16 bp, Artificial Sequence
  synthetic [barcode part1]
agtggagaattcgtac

SEQ ID NO: 41335 - DNA, 16 bp, Artificial Sequence
  synthetic [barcode part1]
caaggtctctctctct

SEQ ID NO: 41336 - DNA, 16 bp, Artificial Sequence
  synthetic [barcode part1]
aacctagtacgtcttc

SEQ ID NO: 41337 - DNA, 16 bp, Artificial Sequence
  synthetic [barcode part1]
tgtccgtagacaagtc

SEQ ID NO: 41338 - DNA, 16 bp, Artificial Sequence
  synthetic [barcode part1]
gttccaacacagtgtg

SEQ ID NO: 41339 - DNA, 16 bp, Artificial Sequence
  synthetic [barcode part1]
gcaactgcctcctagt

SEQ ID NO: 41340 - DNA, 16 bp, Artificial Sequence
  synthetic [barcode part1]
aggactctgtctatct

SEQ ID NO: 41341 - DNA, 16 bp, Artificial Sequence
  synthetic [barcode part1]
tgttcttcacacctcg

SEQ ID NO: 41342 - DNA, 16 bp, Artificial Sequence
  synthetic [barcode part1]
caacagtaccactgac

SEQ ID NO: 41343 - DNA, 16 bp, Artificial Sequence
  synthetic [barcode part1]
gttaggtccgtactcc

SEQ ID NO: 41344 - DNA, 16 bp, Artificial Sequence
  synthetic [barcode part1]
cagacgaccgtgatag

SEQ ID NO: 41345 - DNA, 16 bp, Artificial Sequence
  synthetic [barcode part1]
agagaattgtctcgcc

SEQ ID NO: 41346 - DNA, 16 bp, Artificial Sequence
  synthetic [barcode part1]
tagtaaccgacggtct

SEQ ID NO: 41347 - DNA, 16 bp, Artificial Sequence
  synthetic [barcode part1]
ttattcggcaggcaac

SEQ ID NO: 41348 - DNA, 16 bp, Artificial Sequence
  synthetic [barcode part1]
cggtagacggatactg

SEQ ID NO: 41349 - DNA, 16 bp, Artificial Sequence
  synthetic [barcode part1]
caccggttctcgattg

SEQ ID NO: 41350 - DNA, 16 bp, Artificial Sequence
  synthetic [barcode part1]
ttgtgttagacacggc

SEQ ID NO: 41351 - DNA, 16 bp, Artificial Sequence
  synthetic [barcode part1]
ttcgcgtactactaac

SEQ ID NO: 41352 - DNA, 16 bp, Artificial Sequence
  synthetic [barcode part1]
cgaaccagtacttctt

SEQ ID NO: 41353 - DNA, 16 bp, Artificial Sequence
  synthetic [barcode part1]
gcgactcctcaataag

SEQ ID NO: 41354 - DNA, 16 bp, Artificial Sequence
  synthetic [barcode part1]
actgccgaagacgtag

SEQ ID NO: 41355 - DNA, 16 bp, Artificial Sequence
  synthetic [barcode part1]
ttgacacagaactgag

SEQ ID NO: 41356 - DNA, 16 bp, Artificial Sequence
  synthetic [barcode part1]
tagatagatcctggag

SEQ ID NO: 41357 - DNA, 16 bp, Artificial Sequence
  synthetic [barcode part1]
tcaataagtgaggacc

SEQ ID NO: 41358 - DNA, 16 bp, Artificial Sequence
  synthetic [barcode part1]
gcgcgtgattgcaatt

SEQ ID NO: 41359 - DNA, 16 bp, Artificial Sequence
  synthetic [barcode part1]
gcctgtgacacttaag

SEQ ID NO: 41360 - DNA, 16 bp, Artificial Sequence
  synthetic [barcode part1]
cctagatagtaacgag

SEQ ID NO: 41361 - DNA, 16 bp, Artificial Sequence
  synthetic [barcode part1]
gaggactaccaacgtg

SEQ ID NO: 41362 - DNA, 16 bp, Artificial Sequence
  synthetic [barcode part1]
ttcagttaccggtgcc

SEQ ID NO: 41363 - DNA, 16 bp, Artificial Sequence
  synthetic [barcode part1]
atctgactgtgtcttg

SEQ ID NO: 41364 - DNA, 16 bp, Artificial Sequence
  synthetic [barcode part1]
gaactcgagaccaggt

SEQ ID NO: 41365 - DNA, 16 bp, Artificial Sequence
  synthetic [barcode part1]
aaggacggaattatcc

SEQ ID NO: 41366 - DNA, 16 bp, Artificial Sequence
  synthetic [barcode part1]
gatacctcactccgtg

SEQ ID NO: 41367 - DNA, 16 bp, Artificial Sequence
  synthetic [barcode part1]
tatagttctcttggcg

SEQ ID NO: 41368 - DNA, 16 bp, Artificial Sequence
  synthetic [barcode part1]
gaattacgcctgacgt

SEQ ID NO: 41369 - DNA, 16 bp, Artificial Sequence
  synthetic [barcode part1]
ttacctgcacctacct

SEQ ID NO: 41370 - DNA, 16 bp, Artificial Sequence
  synthetic [barcode part1]
acgttaacctctggtt

SEQ ID NO: 41371 - DNA, 16 bp, Artificial Sequence
  synthetic [barcode part1]
tgccactatccggatc

SEQ ID NO: 41372 - DNA, 16 bp, Artificial Sequence
  synthetic [barcode part1]
tgtattcgtgatctgc

SEQ ID NO: 41373 - DNA, 16 bp, Artificial Sequence
  synthetic [barcode part1]
tccgatccacaactgc

SEQ ID NO: 41374 - DNA, 16 bp, Artificial Sequence
  synthetic [barcode part1]
taagacctggcactac

SEQ ID NO: 41375 - DNA, 16 bp, Artificial Sequence
  synthetic [barcode part1]
cacggaatctctgtag

SEQ ID NO: 41376 - DNA, 16 bp, Artificial Sequence
  synthetic [barcode part1]
tatattgccagaggag

SEQ ID NO: 41377 - DNA, 16 bp, Artificial Sequence
  synthetic [barcode part1]
cgagagtgacagttcg

SEQ ID NO: 41378 - DNA, 16 bp, Artificial Sequence
  synthetic [barcode part1]
gcagaaccgaatattg

SEQ ID NO: 41379 - DNA, 16 bp, Artificial Sequence
  synthetic [barcode part1]
gttgacaacaggatac

SEQ ID NO: 41380 - DNA, 16 bp, Artificial Sequence
  synthetic [barcode part1]
gcctgactgtgttctg

SEQ ID NO: 41381 - DNA, 16 bp, Artificial Sequence
  synthetic [barcode part1]
agagagtgtccttcgt

SEQ ID NO: 41382 - DNA, 16 bp, Artificial Sequence
  synthetic [barcode part1]
gaatctcgattccgag

SEQ ID NO: 41383 - DNA, 16 bp, Artificial Sequence
  synthetic [barcode part1]
gaatcacggtgacttc

SEQ ID NO: 41384 - DNA, 16 bp, Artificial Sequence
  synthetic [barcode part1]
gagacgtacacagaag

SEQ ID NO: 41385 - DNA, 16 bp, Artificial Sequence
  synthetic [barcode part1]
gtgacttgaactgtcg

SEQ ID NO: 41386 - DNA, 16 bp, Artificial Sequence
  synthetic [barcode part1]
tactgacactgtgcag

SEQ ID NO: 41387 - DNA, 16 bp, Artificial Sequence
  synthetic [barcode part1]
agtcttcaactcacgt

SEQ ID NO: 41388 - DNA, 16 bp, Artificial Sequence
  synthetic [barcode part1]
ttatccactcactcgc

SEQ ID NO: 41389 - DNA, 16 bp, Artificial Sequence
  synthetic [barcode part1]
ccacgaactatacggt

SEQ ID NO: 41390 - DNA, 16 bp, Artificial Sequence
  synthetic [barcode part1]
tgcctgtagtaagtgc

SEQ ID NO: 41391 - DNA, 16 bp, Artificial Sequence
  synthetic [barcode part1]
accggtacaagtctgt

SEQ ID NO: 41392 - DNA, 16 bp, Artificial Sequence
  synthetic [barcode part1]
gtcacgcgagagttag

SEQ ID NO: 41393 - DNA, 16 bp, Artificial Sequence
  synthetic [barcode part1]
cctgatctatagtcac

SEQ ID NO: 41394 - DNA, 16 bp, Artificial Sequence
  synthetic [barcode part1]
gcgtaacagttgaagt

SEQ ID NO: 41395 - DNA, 16 bp, Artificial Sequence
  synthetic [barcode part1]
gatcggtgcgtgtatt

SEQ ID NO: 41396 - DNA, 16 bp, Artificial Sequence
  synthetic [barcode part1]
atcttcaggatcactc

SEQ ID NO: 41397 - DNA, 16 bp, Artificial Sequence
  synthetic [barcode part1]
tcaactcggactgagt

SEQ ID NO: 41398 - DNA, 16 bp, Artificial Sequence
  synthetic [barcode part1]
ttctcgagactctcct

SEQ ID NO: 41399 - DNA, 16 bp, Artificial Sequence
  synthetic [barcode part1]
cgaggttgtactacgt

SEQ ID NO: 41400 - DNA, 16 bp, Artificial Sequence
  synthetic [barcode part1]
gcaactaactacgtgc

SEQ ID NO: 41401 - DNA, 16 bp, Artificial Sequence
  synthetic [barcode part1]
cgttaggtggatcgtt

SEQ ID NO: 41402 - DNA, 16 bp, Artificial Sequence
  synthetic [barcode part1]
gagtcaccactgagtt

SEQ ID NO: 41403 - DNA, 16 bp, Artificial Sequence
  synthetic [barcode part1]
ataccagtgattcctc

SEQ ID NO: 41404 - DNA, 16 bp, Artificial Sequence
  synthetic [barcode part1]
gtacaactgtgcgatc

SEQ ID NO: 41405 - DNA, 16 bp, Artificial Sequence
  synthetic [barcode part1]
ccttacctgaacaccg

SEQ ID NO: 41406 - DNA, 16 bp, Artificial Sequence
  synthetic [barcode part1]
gacaatagtgacggag

SEQ ID NO: 41407 - DNA, 16 bp, Artificial Sequence
  synthetic [barcode part1]
tgtcggactgttaggt

SEQ ID NO: 41408 - DNA, 16 bp, Artificial Sequence
  synthetic [barcode part1]
ttgacttgtgattgcc

SEQ ID NO: 41409 - DNA, 16 bp, Artificial Sequence
  synthetic [barcode part1]
cgatcctgcgttagtc

SEQ ID NO: 41410 - DNA, 16 bp, Artificial Sequence
  synthetic [barcode part1]
gtacggcagtcaagac

SEQ ID NO: 41411 - DNA, 16 bp, Artificial Sequence
  synthetic [barcode part1]
attctgcacagtcact

SEQ ID NO: 41412 - DNA, 16 bp, Artificial Sequence
  synthetic [barcode part1]
cacttgtcaccacggt

SEQ ID NO: 41413 - DNA, 16 bp, Artificial Sequence
  synthetic [barcode part1]
gtcgacggtaattacc

SEQ ID NO: 41414 - DNA, 16 bp, Artificial Sequence
  synthetic [barcode part1]
tattgccgtccaagtt

SEQ ID NO: 41415 - DNA, 16 bp, Artificial Sequence
  synthetic [barcode part1]
tcctaatcgtaccggc

SEQ ID NO: 41416 - DNA, 16 bp, Artificial Sequence
  synthetic [barcode part1]
agtgaccagttaccgt

SEQ ID NO: 41417 - DNA, 16 bp, Artificial Sequence
  synthetic [barcode part1]
tgtggagaccagatcg

SEQ ID NO: 41418 - DNA, 16 bp, Artificial Sequence
  synthetic [barcode part1]
tggatctcgtctgaag

SEQ ID NO: 41419 - DNA, 16 bp, Artificial Sequence
  synthetic [barcode part1]
tatccttcgacgattg

SEQ ID NO: 41420 - DNA, 16 bp, Artificial Sequence
  synthetic [barcode part1]
tacctaggatcacacg

SEQ ID NO: 41421 - DNA, 16 bp, Artificial Sequence
  synthetic [barcode part1]
gataacctcaggtcac

SEQ ID NO: 41422 - DNA, 16 bp, Artificial Sequence
  synthetic [barcode part1]
aagactcacctcagac

SEQ ID NO: 41423 - DNA, 16 bp, Artificial Sequence
  synthetic [barcode part1]
acagactcacaggttc

SEQ ID NO: 41424 - DNA, 16 bp, Artificial Sequence
  synthetic [barcode part1]
atcactccaggtactt

SEQ ID NO: 41425 - DNA, 16 bp, Artificial Sequence
  synthetic [barcode part1]
atacgacctaactctc

SEQ ID NO: 41426 - DNA, 16 bp, Artificial Sequence
  synthetic [barcode part1]
attaggatcggtcctg

SEQ ID NO: 41427 - DNA, 16 bp, Artificial Sequence
  synthetic [barcode part1]
ccagtagagtggtctt

SEQ ID NO: 41428 - DNA, 16 bp, Artificial Sequence
  synthetic [barcode part1]
tggactagagagtatc

SEQ ID NO: 41429 - DNA, 16 bp, Artificial Sequence
  synthetic [barcode part1]
aaggtgccaatctaag

SEQ ID NO: 41430 - DNA, 16 bp, Artificial Sequence
  synthetic [barcode part1]
atagagtggcgtccag

SEQ ID NO: 41431 - DNA, 16 bp, Artificial Sequence
  synthetic [barcode part1]
gttacttggattcacc

SEQ ID NO: 41432 - DNA, 16 bp, Artificial Sequence
  synthetic [barcode part1]
atatcaacggtctctc

SEQ ID NO: 41433 - DNA, 16 bp, Artificial Sequence
  synthetic [barcode part1]
ccggcgattatatctt

SEQ ID NO: 41434 - DNA, 16 bp, Artificial Sequence
  synthetic [barcode part1]
cgttggcgattaggag

SEQ ID NO: 41435 - DNA, 16 bp, Artificial Sequence
  synthetic [barcode part1]
attgataacaaggcgc

SEQ ID NO: 41436 - DNA, 16 bp, Artificial Sequence
  synthetic [barcode part1]
caccaagtctacgcct

SEQ ID NO: 41437 - DNA, 16 bp, Artificial Sequence
  synthetic [barcode part1]
acaaccaccggtcttc

SEQ ID NO: 41438 - DNA, 16 bp, Artificial Sequence
  synthetic [barcode part1]
cacgttcagtaattcc

SEQ ID NO: 41439 - DNA, 16 bp, Artificial Sequence
  synthetic [barcode part1]
gtgttagaactcgtgc

SEQ ID NO: 41440 - DNA, 16 bp, Artificial Sequence
  synthetic [barcode part1]
aacttggatcgttggc

SEQ ID NO: 41441 - DNA, 16 bp, Artificial Sequence
  synthetic [barcode part1]
gcgtggtgttgatatc

SEQ ID NO: 41442 - DNA, 16 bp, Artificial Sequence
  synthetic [barcode part1]
gtatagaggacgtgag

SEQ ID NO: 41443 - DNA, 16 bp, Artificial Sequence
  synthetic [barcode part1]
gtactagtacgagtcc

SEQ ID NO: 41444 - DNA, 16 bp, Artificial Sequence
  synthetic [barcode part1]
gtactgagaggatcgc

SEQ ID NO: 41445 - DNA, 16 bp, Artificial Sequence
  synthetic [barcode part1]
gcctggataggacaac

SEQ ID NO: 41446 - DNA, 16 bp, Artificial Sequence
  synthetic [barcode part1]
ccgtccaactctaggt

SEQ ID NO: 41447 - DNA, 16 bp, Artificial Sequence
  synthetic [barcode part1]
tcctagacctagagtg

SEQ ID NO: 41448 - DNA, 16 bp, Artificial Sequence
  synthetic [barcode part1]
tggtagttgcgtcctc

SEQ ID NO: 41449 - DNA, 16 bp, Artificial Sequence
  synthetic [barcode part1]
cgtcaataactggaag

SEQ ID NO: 41450 - DNA, 16 bp, Artificial Sequence
  synthetic [barcode part1]
cggcggttgtactctt

SEQ ID NO: 41451 - DNA, 16 bp, Artificial Sequence
  synthetic [barcode part1]
tgagagagtatcgact

SEQ ID NO: 41452 - DNA, 16 bp, Artificial Sequence
  synthetic [barcode part1]
aatccaggccaagttc

SEQ ID NO: 41453 - DNA, 16 bp, Artificial Sequence
  synthetic [barcode part1]
cgtatagacggttacc

SEQ ID NO: 41454 - DNA, 16 bp, Artificial Sequence
  synthetic [barcode part1]
tataagtggcactcgc

SEQ ID NO: 41455 - DNA, 16 bp, Artificial Sequence
  synthetic [barcode part1]
accgacgttatcgtcc

SEQ ID NO: 41456 - DNA, 16 bp, Artificial Sequence
  synthetic [barcode part1]
aagtatccaagacggt

SEQ ID NO: 41457 - DNA, 16 bp, Artificial Sequence
  synthetic [barcode part1]
gcgtggcagagaatct

SEQ ID NO: 41458 - DNA, 16 bp, Artificial Sequence
  synthetic [barcode part1]
gtcggacttatattcc

SEQ ID NO: 41459 - DNA, 16 bp, Artificial Sequence
  synthetic [barcode part1]
cgcaacgaggtaagtc

SEQ ID NO: 41460 - DNA, 16 bp, Artificial Sequence
  synthetic [barcode part1]
aagatcttggacaggt

SEQ ID NO: 41461 - DNA, 16 bp, Artificial Sequence
  synthetic [barcode part1]
attccagtgatcggtg

SEQ ID NO: 41462 - DNA, 16 bp, Artificial Sequence
  synthetic [barcode part1]
gaatcgtcctatatcc

SEQ ID NO: 41463 - DNA, 16 bp, Artificial Sequence
  synthetic [barcode part1]
tcctcagtgcaattac

SEQ ID NO: 41464 - DNA, 16 bp, Artificial Sequence
  synthetic [barcode part1]
tgatcttatcgacgtc

SEQ ID NO: 41465 - DNA, 16 bp, Artificial Sequence
  synthetic [barcode part1]
tgtctgtactccaagt

SEQ ID NO: 41466 - DNA, 16 bp, Artificial Sequence
  synthetic [barcode part1]
agactctaggatcctg

SEQ ID NO: 41467 - DNA, 16 bp, Artificial Sequence
  synthetic [barcode part1]
tcgaacgagactcact

SEQ ID NO: 41468 - DNA, 16 bp, Artificial Sequence
  synthetic [barcode part1]
tgaattgccgaaccgt

SEQ ID NO: 41469 - DNA, 16 bp, Artificial Sequence
  synthetic [barcode part1]
tcactgcaatacttgc

SEQ ID NO: 41470 - DNA, 16 bp, Artificial Sequence
  synthetic [barcode part1]
tggtgattcctcgcac

SEQ ID NO: 41471 - DNA, 16 bp, Artificial Sequence
  synthetic [barcode part1]
aagtccttagtcgacg

SEQ ID NO: 41472 - DNA, 16 bp, Artificial Sequence
  synthetic [barcode part1]
cctgtcagttgtcttc

SEQ ID NO: 41473 - DNA, 16 bp, Artificial Sequence
  synthetic [barcode part1]
cgattctcagtgtgtt

SEQ ID NO: 41474 - DNA, 16 bp, Artificial Sequence
  synthetic [barcode part1]
tacgtctgacgattct

SEQ ID NO: 41475 - DNA, 16 bp, Artificial Sequence
  synthetic [barcode part1]
acacgttcttgatctg

SEQ ID NO: 41476 - DNA, 16 bp, Artificial Sequence
  synthetic [barcode part1]
tataggaccttgcgtg

SEQ ID NO: 41477 - DNA, 16 bp, Artificial Sequence
  synthetic [barcode part1]
tcaaggtgacactacc

SEQ ID NO: 41478 - DNA, 16 bp, Artificial Sequence
  synthetic [barcode part1]
cgccttggataaggtt

SEQ ID NO: 41479 - DNA, 16 bp, Artificial Sequence
  synthetic [barcode part1]
cgtatagtacctcgcc

SEQ ID NO: 41480 - DNA, 16 bp, Artificial Sequence
  synthetic [barcode part1]
ttggtgaccacgtctc

SEQ ID NO: 41481 - DNA, 16 bp, Artificial Sequence
  synthetic [barcode part1]
gcagtgaacttaggcg

SEQ ID NO: 41482 - DNA, 16 bp, Artificial Sequence
  synthetic [barcode part1]
ccgcactaagttactt

SEQ ID NO: 41483 - DNA, 16 bp, Artificial Sequence
  synthetic [barcode part1]
ccgtaagtaaggaact

SEQ ID NO: 41484 - DNA, 16 bp, Artificial Sequence
  synthetic [barcode part1]
agtccaggtatagagt

SEQ ID NO: 41485 - DNA, 16 bp, Artificial Sequence
  synthetic [barcode part1]
ttgttcactcggaatc

SEQ ID NO: 41486 - DNA, 16 bp, Artificial Sequence
  synthetic [barcode part1]
tatcacggtcggttag

SEQ ID NO: 41487 - DNA, 16 bp, Artificial Sequence
  synthetic [barcode part1]
tgttcgattctgtcag

SEQ ID NO: 41488 - DNA, 16 bp, Artificial Sequence
  synthetic [barcode part1]
cacacggacaaggtac

SEQ ID NO: 41489 - DNA, 16 bp, Artificial Sequence
  synthetic [barcode part1]
gtacactcgttggtag

SEQ ID NO: 41490 - DNA, 16 bp, Artificial Sequence
  synthetic [barcode part1]
gaggtcaatatctgag

SEQ ID NO: 41491 - DNA, 16 bp, Artificial Sequence
  synthetic [barcode part1]
tagtgtaccgacgtgt

SEQ ID NO: 41492 - DNA, 16 bp, Artificial Sequence
  synthetic [barcode part1]
ccacgtcctatcaggt

SEQ ID NO: 41493 - DNA, 16 bp, Artificial Sequence
  synthetic [barcode part1]
cggagtatcgttactg

SEQ ID NO: 41494 - DNA, 16 bp, Artificial Sequence
  synthetic [barcode part1]
accttgtgtgagacgt

SEQ ID NO: 41495 - DNA, 16 bp, Artificial Sequence
  synthetic [barcode part1]
tgtgacttacgccaag

SEQ ID NO: 41496 - DNA, 16 bp, Artificial Sequence
  synthetic [barcode part1]
ccttagtctaacacgt

SEQ ID NO: 41497 - DNA, 16 bp, Artificial Sequence
  synthetic [barcode part1]
tacaccaatcgcgtag

SEQ ID NO: 41498 - DNA, 16 bp, Artificial Sequence
  synthetic [barcode part1]
agattccggaaggaag

SEQ ID NO: 41499 - DNA, 16 bp, Artificial Sequence
  synthetic [barcode part1]
tcacctcgtgtggttg

SEQ ID NO: 41500 - DNA, 16 bp, Artificial Sequence
  synthetic [barcode part1]
actcggacggatatct

SEQ ID NO: 41501 - DNA, 16 bp, Artificial Sequence
  synthetic [barcode part1]
gacacgatatcctcag

SEQ ID NO: 41502 - DNA, 16 bp, Artificial Sequence
  synthetic [barcode part1]
gacgacctaacaactc

SEQ ID NO: 41503 - DNA, 16 bp, Artificial Sequence
  synthetic [barcode part1]
caggagttccgtattg

SEQ ID NO: 41504 - DNA, 16 bp, Artificial Sequence
  synthetic [barcode part1]
atccaaggacacttgc

SEQ ID NO: 41505 - DNA, 16 bp, Artificial Sequence
  synthetic [barcode part1]
tggaatcgtcgtaacc

SEQ ID NO: 41506 - DNA, 16 bp, Artificial Sequence
  synthetic [barcode part1]
actcgcgttaagtgtg

SEQ ID NO: 41507 - DNA, 16 bp, Artificial Sequence
  synthetic [barcode part1]
acaggtcgttactctt

SEQ ID NO: 41508 - DNA, 16 bp, Artificial Sequence
  synthetic [barcode part1]
tcaggacgtctgtcct

SEQ ID NO: 41509 - DNA, 16 bp, Artificial Sequence
  synthetic [barcode part1]
gagagaactgagactg

SEQ ID NO: 41510 - DNA, 16 bp, Artificial Sequence
  synthetic [barcode part1]
cctgcgagatacttag

SEQ ID NO: 41511 - DNA, 16 bp, Artificial Sequence
  synthetic [barcode part1]
cgtacgacctgacctt

SEQ ID NO: 41512 - DNA, 16 bp, Artificial Sequence
  synthetic [barcode part1]
cggccttattgcgtgt

SEQ ID NO: 41513 - DNA, 16 bp, Artificial Sequence
  synthetic [barcode part1]
atccagtcagttcgag

SEQ ID NO: 41514 - DNA, 16 bp, Artificial Sequence
  synthetic [barcode part1]
cctccaacgatacacc

SEQ ID NO: 41515 - DNA, 16 bp, Artificial Sequence
  synthetic [barcode part1]
ttcttctgtgtcgcgt

SEQ ID NO: 41516 - DNA, 16 bp, Artificial Sequence
  synthetic [barcode part1]
tcgtagacgaggagtc

SEQ ID NO: 41517 - DNA, 16 bp, Artificial Sequence
  synthetic [barcode part1]
atctaggtactcaggc

SEQ ID NO: 41518 - DNA, 16 bp, Artificial Sequence
  synthetic [barcode part1]
agtcgcgatatcagtc

SEQ ID NO: 41519 - DNA, 16 bp, Artificial Sequence
  synthetic [barcode part1]
ttgcaccacaggaatc

SEQ ID NO: 41520 - DNA, 16 bp, Artificial Sequence
  synthetic [barcode part1]
cagtcaatcctccttc

SEQ ID NO: 41521 - DNA, 16 bp, Artificial Sequence
  synthetic [barcode part1]
gagtggtatattcgag

SEQ ID NO: 41522 - DNA, 16 bp, Artificial Sequence
  synthetic [barcode part1]
cgcaagaacacaagag

SEQ ID NO: 41523 - DNA, 16 bp, Artificial Sequence
  synthetic [barcode part1]
tcgacagtcgcgtctt

SEQ ID NO: 41524 - DNA, 16 bp, Artificial Sequence
  synthetic [barcode part1]
tgaacacttggtgcac

SEQ ID NO: 41525 - DNA, 16 bp, Artificial Sequence
  synthetic [barcode part1]
agtataggatagtccg

SEQ ID NO: 41526 - DNA, 16 bp, Artificial Sequence
  synthetic [barcode part1]
gaactgtgtctaacgc

SEQ ID NO: 41527 - DNA, 16 bp, Artificial Sequence
  synthetic [barcode part1]
cagaatcttgactggc

SEQ ID NO: 41528 - DNA, 16 bp, Artificial Sequence
  synthetic [barcode part1]
acctgagatctgtggt

SEQ ID NO: 41529 - DNA, 16 bp, Artificial Sequence
  synthetic [barcode part1]
acaccgaccgagtatt

SEQ ID NO: 41530 - DNA, 16 bp, Artificial Sequence
  synthetic [barcode part1]
gttgtcacctcgtgtg

SEQ ID NO: 41531 - DNA, 16 bp, Artificial Sequence
  synthetic [barcode part1]
cgtgagatcctatacg

SEQ ID NO: 41532 - DNA, 16 bp, Artificial Sequence
  synthetic [barcode part1]
tatctcggaacggtgt

SEQ ID NO: 41533 - DNA, 16 bp, Artificial Sequence
  synthetic [barcode part1]
ttgacttggtacgttc

SEQ ID NO: 41534 - DNA, 16 bp, Artificial Sequence
  synthetic [barcode part1]
acaacctaagtcaccg

SEQ ID NO: 41535 - DNA, 16 bp, Artificial Sequence
  synthetic [barcode part1]
acttggacaagacaac

SEQ ID NO: 41536 - DNA, 16 bp, Artificial Sequence
  synthetic [barcode part1]
tcgacaatcgtatctc

SEQ ID NO: 41537 - DNA, 16 bp, Artificial Sequence
  synthetic [barcode part1]
tgtatctaacgcaggc

SEQ ID NO: 41538 - DNA, 16 bp, Artificial Sequence
  synthetic [barcode part1]
gattgtaccagaaggt

SEQ ID NO: 41539 - DNA, 16 bp, Artificial Sequence
  synthetic [barcode part1]
ccaccttcttctagtg

SEQ ID NO: 41540 - DNA, 16 bp, Artificial Sequence
  synthetic [barcode part1]
tcgcggacttgacttc

SEQ ID NO: 41541 - DNA, 16 bp, Artificial Sequence
  synthetic [barcode part1]
tcgacaagacgacttc

SEQ ID NO: 41542 - DNA, 16 bp, Artificial Sequence
  synthetic [barcode part1]
gagtccaatagaacgt

SEQ ID NO: 41543 - DNA, 16 bp, Artificial Sequence
  synthetic [barcode part1]
gatatccgacgtatcg

SEQ ID NO: 41544 - DNA, 16 bp, Artificial Sequence
  synthetic [barcode part1]
ttgaacgtgaggcgac

SEQ ID NO: 41545 - DNA, 16 bp, Artificial Sequence
  synthetic [barcode part1]
gtagaccaactcacgt

SEQ ID NO: 41546 - DNA, 16 bp, Artificial Sequence
  synthetic [barcode part1]
cgaagttagagaggac

SEQ ID NO: 41547 - DNA, 16 bp, Artificial Sequence
  synthetic [barcode part1]
tccttatctgtcagag

SEQ ID NO: 41548 - DNA, 16 bp, Artificial Sequence
  synthetic [barcode part1]
gactgtaaggaagttc

SEQ ID NO: 41549 - DNA, 16 bp, Artificial Sequence
  synthetic [barcode part1]
taggaatcctacgtcg

SEQ ID NO: 41550 - DNA, 16 bp, Artificial Sequence
  synthetic [barcode part1]
tgagaattcacgtccg

SEQ ID NO: 41551 - DNA, 16 bp, Artificial Sequence
  synthetic [barcode part1]
tggagagtgtaactac

SEQ ID NO: 41552 - DNA, 16 bp, Artificial Sequence
  synthetic [barcode part1]
ccgttgtcagatattc

SEQ ID NO: 41553 - DNA, 16 bp, Artificial Sequence
  synthetic [barcode part1]
gactggcgttatagtc

SEQ ID NO: 41554 - DNA, 16 bp, Artificial Sequence
  synthetic [barcode part1]
tggagaggagactaac

SEQ ID NO: 41555 - DNA, 16 bp, Artificial Sequence
  synthetic [barcode part1]
tccaacttacacggtt

SEQ ID NO: 41556 - DNA, 16 bp, Artificial Sequence
  synthetic [barcode part1]
gcaacgagagtgtctg

SEQ ID NO: 41557 - DNA, 16 bp, Artificial Sequence
  synthetic [barcode part1]
tacggaggacttggtg

SEQ ID NO: 41558 - DNA, 16 bp, Artificial Sequence
  synthetic [barcode part1]
atcttactcgcacaac

SEQ ID NO: 41559 - DNA, 16 bp, Artificial Sequence
  synthetic [barcode part1]
ttcggatcgtcaacag

SEQ ID NO: 41560 - DNA, 16 bp, Artificial Sequence
  synthetic [barcode part1]
gtccggagtcttgttc

SEQ ID NO: 41561 - DNA, 16 bp, Artificial Sequence
  synthetic [barcode part1]
gtctggaataacgagt

SEQ ID NO: 41562 - DNA, 16 bp, Artificial Sequence
  synthetic [barcode part1]
gtctgcctggaacctt

SEQ ID NO: 41563 - DNA, 16 bp, Artificial Sequence
  synthetic [barcode part1]
tcacgccggactactt

SEQ ID NO: 41564 - DNA, 16 bp, Artificial Sequence
  synthetic [barcode part1]
actcgttgttctgagt

SEQ ID NO: 41565 - DNA, 16 bp, Artificial Sequence
  synthetic [barcode part1]
gttactcacggcaagt

SEQ ID NO: 41566 - DNA, 16 bp, Artificial Sequence
  synthetic [barcode part1]
ttggtaaggacgtagt

SEQ ID NO: 41567 - DNA, 16 bp, Artificial Sequence
  synthetic [barcode part1]
tgtagaactaggtcag

SEQ ID NO: 41568 - DNA, 16 bp, Artificial Sequence
  synthetic [barcode part1]
tacggtaattcgtctc

SEQ ID NO: 41569 - DNA, 16 bp, Artificial Sequence
  synthetic [barcode part1]
attaggaaggagaccg

SEQ ID NO: 41570 - DNA, 16 bp, Artificial Sequence
  synthetic [barcode part1]
tcgagagttcctagtg

SEQ ID NO: 41571 - DNA, 16 bp, Artificial Sequence
  synthetic [barcode part1]
tctcgtcacagatccg

SEQ ID NO: 41572 - DNA, 16 bp, Artificial Sequence
  synthetic [barcode part1]
cacgcgtctaattgag

SEQ ID NO: 41573 - DNA, 16 bp, Artificial Sequence
  synthetic [barcode part1]
atacagagagtgcgag

SEQ ID NO: 41574 - DNA, 16 bp, Artificial Sequence
  synthetic [barcode part1]
ttggtaggtccttatc

SEQ ID NO: 41575 - DNA, 16 bp, Artificial Sequence
  synthetic [barcode part1]
cggtaactacaagagt

SEQ ID NO: 41576 - DNA, 16 bp, Artificial Sequence
  synthetic [barcode part1]
gtcagtatcactatcc

SEQ ID NO: 41577 - DNA, 16 bp, Artificial Sequence
  synthetic [barcode part1]
ttgacacacgtcaacg

SEQ ID NO: 41578 - DNA, 16 bp, Artificial Sequence
  synthetic [barcode part1]
ccgtcgtagtaagact

SEQ ID NO: 41579 - DNA, 16 bp, Artificial Sequence
  synthetic [barcode part1]
acaaccgttccttagt

SEQ ID NO: 41580 - DNA, 16 bp, Artificial Sequence
  synthetic [barcode part1]
gattctcgtcgagagt

SEQ ID NO: 41581 - DNA, 16 bp, Artificial Sequence
  synthetic [barcode part1]
cagttcttcttccggt

SEQ ID NO: 41582 - DNA, 16 bp, Artificial Sequence
  synthetic [barcode part1]
gatcgtacacacaacc

SEQ ID NO: 41583 - DNA, 16 bp, Artificial Sequence
  synthetic [barcode part1]
tgacgtatcaggtacc

SEQ ID NO: 41584 - DNA, 16 bp, Artificial Sequence
  synthetic [barcode part1]
gactaggacgactgtg

SEQ ID NO: 41585 - DNA, 16 bp, Artificial Sequence
  synthetic [barcode part1]
gaatctaccaccactt

SEQ ID NO: 41586 - DNA, 16 bp, Artificial Sequence
  synthetic [barcode part1]
ttgataacgtcttcgc

SEQ ID NO: 41587 - DNA, 16 bp, Artificial Sequence
  synthetic [barcode part1]
ttctgccagtgtccag

SEQ ID NO: 41588 - DNA, 16 bp, Artificial Sequence
  synthetic [barcode part1]
cctgttatacactggt

SEQ ID NO: 41589 - DNA, 16 bp, Artificial Sequence
  synthetic [barcode part1]
gataaccaagagtgtc

SEQ ID NO: 41590 - DNA, 16 bp, Artificial Sequence
  synthetic [barcode part1]
acaaccacgcgtaatc

SEQ ID NO: 41591 - DNA, 16 bp, Artificial Sequence
  synthetic [barcode part1]
tctcacgattgaactc

SEQ ID NO: 41592 - DNA, 16 bp, Artificial Sequence
  synthetic [barcode part1]
ccaccagtcctatacg

SEQ ID NO: 41593 - DNA, 16 bp, Artificial Sequence
  synthetic [barcode part1]
attccgcactcggatc

SEQ ID NO: 41594 - DNA, 16 bp, Artificial Sequence
  synthetic [barcode part1]
accgacgaccttctac

SEQ ID NO: 41595 - DNA, 16 bp, Artificial Sequence
  synthetic [barcode part1]
aatcaatcgtggcacc

SEQ ID NO: 41596 - DNA, 16 bp, Artificial Sequence
  synthetic [barcode part1]
ccaggtatcgcaagtt

SEQ ID NO: 41597 - DNA, 16 bp, Artificial Sequence
  synthetic [barcode part1]
cgtacctacctaatac

SEQ ID NO: 41598 - DNA, 16 bp, Artificial Sequence
  synthetic [barcode part1]
caccagaccgtactct

SEQ ID NO: 41599 - DNA, 16 bp, Artificial Sequence
  synthetic [barcode part1]
tcggcaggtaaggatc

SEQ ID NO: 41600 - DNA, 16 bp, Artificial Sequence
  synthetic [barcode part1]
tgccactcgagtctac

SEQ ID NO: 41601 - DNA, 16 bp, Artificial Sequence
  synthetic [barcode part1]
tggagacggtagtctg

SEQ ID NO: 41602 - DNA, 16 bp, Artificial Sequence
  synthetic [barcode part1]
gaggtctgaattccgt

SEQ ID NO: 41603 - DNA, 16 bp, Artificial Sequence
  synthetic [barcode part1]
aacgtctcgttccgtg

SEQ ID NO: 41604 - DNA, 16 bp, Artificial Sequence
  synthetic [barcode part1]
caggtatctaagtgcc

SEQ ID NO: 41605 - DNA, 16 bp, Artificial Sequence
  synthetic [barcode part1]
gcaagacgtccgtaag

SEQ ID NO: 41606 - DNA, 16 bp, Artificial Sequence
  synthetic [barcode part1]
taccgtactagaaccg

SEQ ID NO: 41607 - DNA, 16 bp, Artificial Sequence
  synthetic [barcode part1]
cggattagtacgaggc

SEQ ID NO: 41608 - DNA, 16 bp, Artificial Sequence
  synthetic [barcode part1]
tacgtgttcgagatcg

SEQ ID NO: 41609 - DNA, 16 bp, Artificial Sequence
  synthetic [barcode part1]
gcctacttctacctac

SEQ ID NO: 41610 - DNA, 16 bp, Artificial Sequence
  synthetic [barcode part1]
gagacttctatctgtc

SEQ ID NO: 41611 - DNA, 16 bp, Artificial Sequence
  synthetic [barcode part1]
ttgaggtctcgagatc

SEQ ID NO: 41612 - DNA, 16 bp, Artificial Sequence
  synthetic [barcode part1]
tacgcctaggttattc

SEQ ID NO: 41613 - DNA, 16 bp, Artificial Sequence
  synthetic [barcode part1]
caagatctgtgtacgc

SEQ ID NO: 41614 - DNA, 16 bp, Artificial Sequence
  synthetic [barcode part1]
attctctgtgcgttag

SEQ ID NO: 41615 - DNA, 16 bp, Artificial Sequence
  synthetic [barcode part1]
ttcgacttacgtgact

SEQ ID NO: 41616 - DNA, 16 bp, Artificial Sequence
  synthetic [barcode part1]
gaggatagtctaacgt

SEQ ID NO: 41617 - DNA, 16 bp, Artificial Sequence
  synthetic [barcode part1]
gacacacggttgaggt

SEQ ID NO: 41618 - DNA, 16 bp, Artificial Sequence
  synthetic [barcode part1]
tagtccaaggcgtgag

SEQ ID NO: 41619 - DNA, 16 bp, Artificial Sequence
  synthetic [barcode part1]
tggtcttgtcaacgtt

SEQ ID NO: 41620 - DNA, 16 bp, Artificial Sequence
  synthetic [barcode part1]
tctggttgtaccaact

SEQ ID NO: 41621 - DNA, 16 bp, Artificial Sequence
  synthetic [barcode part1]
acgatcttaggtcacg

SEQ ID NO: 41622 - DNA, 16 bp, Artificial Sequence
  synthetic [barcode part1]
tatcgaggcgaaggtc

SEQ ID NO: 41623 - DNA, 16 bp, Artificial Sequence
  synthetic [barcode part1]
accgttcacggacttc

SEQ ID NO: 41624 - DNA, 16 bp, Artificial Sequence
  synthetic [barcode part1]
acacagtggagttggc

SEQ ID NO: 41625 - DNA, 16 bp, Artificial Sequence
  synthetic [barcode part1]
tcctgcagtcaagtcc

SEQ ID NO: 41626 - DNA, 16 bp, Artificial Sequence
  synthetic [barcode part1]
gccgatagacgtactt

SEQ ID NO: 41627 - DNA, 16 bp, Artificial Sequence
  synthetic [barcode part1]
acgaactccttcaatc

SEQ ID NO: 41628 - DNA, 16 bp, Artificial Sequence
  synthetic [barcode part1]
gagacctctgtccact

SEQ ID NO: 41629 - DNA, 16 bp, Artificial Sequence
  synthetic [barcode part1]
tggatctacttgcgag

SEQ ID NO: 41630 - DNA, 16 bp, Artificial Sequence
  synthetic [barcode part1]
aacgatccgatccaac

SEQ ID NO: 41631 - DNA, 16 bp, Artificial Sequence
  synthetic [barcode part1]
caggcacaaggattgc

SEQ ID NO: 41632 - DNA, 16 bp, Artificial Sequence
  synthetic [barcode part1]
gacaattcacacctct

SEQ ID NO: 41633 - DNA, 16 bp, Artificial Sequence
  synthetic [barcode part1]
ttacttacaccgtggt

SEQ ID NO: 41634 - DNA, 16 bp, Artificial Sequence
  synthetic [barcode part1]
gtcttcgatagtccgc

SEQ ID NO: 41635 - DNA, 16 bp, Artificial Sequence
  synthetic [barcode part1]
gaacgaggacgaatac

SEQ ID NO: 41636 - DNA, 16 bp, Artificial Sequence
  synthetic [barcode part1]
ccttagacaggtggag

SEQ ID NO: 41637 - DNA, 16 bp, Artificial Sequence
  synthetic [barcode part1]
tacggttgactacgtg

SEQ ID NO: 41638 - DNA, 16 bp, Artificial Sequence
  synthetic [barcode part1]
cggtctccacgattgt

SEQ ID NO: 41639 - DNA, 16 bp, Artificial Sequence
  synthetic [barcode part1]
tcagacgtccactatt

SEQ ID NO: 41640 - DNA, 16 bp, Artificial Sequence
  synthetic [barcode part1]
gagatcgatatccaag

SEQ ID NO: 41641 - DNA, 16 bp, Artificial Sequence
  synthetic [barcode part1]
tcggagttgttgcagt

SEQ ID NO: 41642 - DNA, 16 bp, Artificial Sequence
  synthetic [barcode part1]
gtattcgacaacagag

SEQ ID NO: 41643 - DNA, 16 bp, Artificial Sequence
  synthetic [barcode part1]
tgttactccacgcgac

SEQ ID NO: 41644 - DNA, 16 bp, Artificial Sequence
  synthetic [barcode part1]
aaggagaccgaagttg

SEQ ID NO: 41645 - DNA, 16 bp, Artificial Sequence
  synthetic [barcode part1]
gtggaacaggtctgtg

SEQ ID NO: 41646 - DNA, 16 bp, Artificial Sequence
  synthetic [barcode part1]
tcggtcttctgatctc

SEQ ID NO: 41647 - DNA, 16 bp, Artificial Sequence
  synthetic [barcode part1]
caagtctgacggagtg

SEQ ID NO: 41648 - DNA, 16 bp, Artificial Sequence
  synthetic [barcode part1]
tcttcggtcctctaac

SEQ ID NO: 41649 - DNA, 16 bp, Artificial Sequence
  synthetic [barcode part1]
gtacctcggttattac

SEQ ID NO: 41650 - DNA, 16 bp, Artificial Sequence
  synthetic [barcode part1]
tgaacgcgattcgtgt

SEQ ID NO: 41651 - DNA, 16 bp, Artificial Sequence
  synthetic [barcode part1]
cgttaacttccggtcg

SEQ ID NO: 41652 - DNA, 16 bp, Artificial Sequence
  synthetic [barcode part1]
actggtgtcactgcct

SEQ ID NO: 41653 - DNA, 16 bp, Artificial Sequence
  synthetic [barcode part1]
ttacgaagtaggacgt

SEQ ID NO: 41654 - DNA, 16 bp, Artificial Sequence
  synthetic [barcode part1]
caatacgttggcacac

SEQ ID NO: 41655 - DNA, 16 bp, Artificial Sequence
  synthetic [barcode part1]
tgttaggcaagtcacc

SEQ ID NO: 41656 - DNA, 16 bp, Artificial Sequence
  synthetic [barcode part1]
tacaacgccgtagtac

SEQ ID NO: 41657 - DNA, 16 bp, Artificial Sequence
  synthetic [barcode part1]
tcactcgagacttcgc

SEQ ID NO: 41658 - DNA, 16 bp, Artificial Sequence
  synthetic [barcode part1]
caccttcgtcgtcaag

SEQ ID NO: 41659 - DNA, 16 bp, Artificial Sequence
  synthetic [barcode part1]
cagatcgatatcctct

SEQ ID NO: 41660 - DNA, 16 bp, Artificial Sequence
  synthetic [barcode part1]
caggacttgcaacgtt

SEQ ID NO: 41661 - DNA, 16 bp, Artificial Sequence
  synthetic [barcode part1]
acgacacctgactagt

SEQ ID NO: 41662 - DNA, 16 bp, Artificial Sequence
  synthetic [barcode part1]
ccttgtgtcttgtacc

SEQ ID NO: 41663 - DNA, 16 bp, Artificial Sequence
  synthetic [barcode part1]
tacggagttggtgacg

SEQ ID NO: 41664 - DNA, 16 bp, Artificial Sequence
  synthetic [barcode part1]
gacgtgatctataccg

SEQ ID NO: 41665 - DNA, 16 bp, Artificial Sequence
  synthetic [barcode part1]
atagtcgtaacgcacc

SEQ ID NO: 41666 - DNA, 16 bp, Artificial Sequence
  synthetic [barcode part1]
cacttagaactgcacg

SEQ ID NO: 41667 - DNA, 16 bp, Artificial Sequence
  synthetic [barcode part1]
tctcagttacgttggt

SEQ ID NO: 41668 - DNA, 16 bp, Artificial Sequence
  synthetic [barcode part1]
cctacgtcgtattctc

SEQ ID NO: 41669 - DNA, 16 bp, Artificial Sequence
  synthetic [barcode part1]
gaggtaagtcttgcct

SEQ ID NO: 41670 - DNA, 16 bp, Artificial Sequence
  synthetic [barcode part1]
acagtaccagtcaacc

SEQ ID NO: 41671 - DNA, 16 bp, Artificial Sequence
  synthetic [barcode part1]
tgcgcggaataatagt

SEQ ID NO: 41672 - DNA, 16 bp, Artificial Sequence
  synthetic [barcode part1]
tgccggaacaaggatc

SEQ ID NO: 41673 - DNA, 16 bp, Artificial Sequence
  synthetic [barcode part1]
ttgtgcaacaccagtg

SEQ ID NO: 41674 - DNA, 16 bp, Artificial Sequence
  synthetic [barcode part1]
gcacgcacaattgatc

SEQ ID NO: 41675 - DNA, 16 bp, Artificial Sequence
  synthetic [barcode part1]
tacttggacactcgag

SEQ ID NO: 41676 - DNA, 16 bp, Artificial Sequence
  synthetic [barcode part1]
taacaacgcgcgaggt

SEQ ID NO: 41677 - DNA, 16 bp, Artificial Sequence
  synthetic [barcode part1]
tcaggttacacttctg

SEQ ID NO: 41678 - DNA, 16 bp, Artificial Sequence
  synthetic [barcode part1]
gttccaccgaactcac

SEQ ID NO: 41679 - DNA, 16 bp, Artificial Sequence
  synthetic [barcode part1]
aactattggacgcaag

SEQ ID NO: 41680 - DNA, 16 bp, Artificial Sequence
  synthetic [barcode part1]
caattctgaggagtcc

SEQ ID NO: 41681 - DNA, 16 bp, Artificial Sequence
  synthetic [barcode part1]
ccaagtgacgaactct

SEQ ID NO: 41682 - DNA, 16 bp, Artificial Sequence
  synthetic [barcode part1]
aacagtctggtctgac

SEQ ID NO: 41683 - DNA, 16 bp, Artificial Sequence
  synthetic [barcode part1]
gtctattaccttggac

SEQ ID NO: 41684 - DNA, 16 bp, Artificial Sequence
  synthetic [barcode part1]
aggattaagtccacag

SEQ ID NO: 41685 - DNA, 16 bp, Artificial Sequence
  synthetic [barcode part1]
gccgaattaccaggtt

SEQ ID NO: 41686 - DNA, 16 bp, Artificial Sequence
  synthetic [barcode part1]
tcctcggattgatact

SEQ ID NO: 41687 - DNA, 16 bp, Artificial Sequence
  synthetic [barcode part1]
tgtcaggtcgttgagt

SEQ ID NO: 41688 - DNA, 16 bp, Artificial Sequence
  synthetic [barcode part1]
ttctaactgcgaactc

SEQ ID NO: 41689 - DNA, 16 bp, Artificial Sequence
  synthetic [barcode part1]
tccactggtcaagaac

SEQ ID NO: 41690 - DNA, 16 bp, Artificial Sequence
  synthetic [barcode part1]
atactaacggtcttcc

SEQ ID NO: 41691 - DNA, 16 bp, Artificial Sequence
  synthetic [barcode part1]
tgcctactcacggtac

SEQ ID NO: 41692 - DNA, 16 bp, Artificial Sequence
  synthetic [barcode part1]
ccggcgagataattct

SEQ ID NO: 41693 - DNA, 16 bp, Artificial Sequence
  synthetic [barcode part1]
ttacttggtggcgtcc

SEQ ID NO: 41694 - DNA, 16 bp, Artificial Sequence
  synthetic [barcode part1]
aattcgcctcgagtag

SEQ ID NO: 41695 - DNA, 16 bp, Artificial Sequence
  synthetic [barcode part1]
tcaccgtgtagacctc

SEQ ID NO: 41696 - DNA, 16 bp, Artificial Sequence
  synthetic [barcode part1]
cacgaatcactgcctc

SEQ ID NO: 41697 - DNA, 16 bp, Artificial Sequence
  synthetic [barcode part1]
ataaggttccgaacag

SEQ ID NO: 41698 - DNA, 16 bp, Artificial Sequence
  synthetic [barcode part1]
agtcgcaaggactggt

SEQ ID NO: 41699 - DNA, 16 bp, Artificial Sequence
  synthetic [barcode part1]
atagtgcgcgtatacc

SEQ ID NO: 41700 - DNA, 16 bp, Artificial Sequence
  synthetic [barcode part1]
tcaagatcgagtgagt

SEQ ID NO: 41701 - DNA, 16 bp, Artificial Sequence
  synthetic [barcode part1]
tattccttggcgattg

SEQ ID NO: 41702 - DNA, 16 bp, Artificial Sequence
  synthetic [barcode part1]
atccgcggtacttaag

SEQ ID NO: 41703 - DNA, 16 bp, Artificial Sequence
  synthetic [barcode part1]
atctgacttctgcgcg

SEQ ID NO: 41704 - DNA, 16 bp, Artificial Sequence
  synthetic [barcode part1]
taggccagtatagagt

SEQ ID NO: 41705 - DNA, 16 bp, Artificial Sequence
  synthetic [barcode part1]
cagacgcgttacttcc

SEQ ID NO: 41706 - DNA, 16 bp, Artificial Sequence
  synthetic [barcode part1]
aacaacaggcagaacg

SEQ ID NO: 41707 - DNA, 16 bp, Artificial Sequence
  synthetic [barcode part1]
tgaatccggacggtag

SEQ ID NO: 41708 - DNA, 16 bp, Artificial Sequence
  synthetic [barcode part1]
ccaacttaggtgtctt

SEQ ID NO: 41709 - DNA, 16 bp, Artificial Sequence
  synthetic [barcode part1]
atctgaatccaggcgt

SEQ ID NO: 41710 - DNA, 16 bp, Artificial Sequence
  synthetic [barcode part1]
tcttgcacacactcct

SEQ ID NO: 41711 - DNA, 16 bp, Artificial Sequence
  synthetic [barcode part1]
actgaggtcttctgag

SEQ ID NO: 41712 - DNA, 16 bp, Artificial Sequence
  synthetic [barcode part1]
ccaatccgaatcagac

SEQ ID NO: 41713 - DNA, 16 bp, Artificial Sequence
  synthetic [barcode part1]
tcaagtgcaagtgtcc

SEQ ID NO: 41714 - DNA, 16 bp, Artificial Sequence
  synthetic [barcode part1]
gtggtcagaggtcagt

SEQ ID NO: 41715 - DNA, 16 bp, Artificial Sequence
  synthetic [barcode part1]
gacacacaaccgaggt

SEQ ID NO: 41716 - DNA, 16 bp, Artificial Sequence
  synthetic [barcode part1]
gcgagtatattcgtcg

SEQ ID NO: 41717 - DNA, 16 bp, Artificial Sequence
  synthetic [barcode part1]
gaagtcgaggagttag

SEQ ID NO: 41718 - DNA, 16 bp, Artificial Sequence
  synthetic [barcode part1]
aggcctgacagaacac

SEQ ID NO: 41719 - DNA, 16 bp, Artificial Sequence
  synthetic [barcode part1]
agtgatatagacaccg

SEQ ID NO: 41720 - DNA, 16 bp, Artificial Sequence
  synthetic [barcode part1]
cagtgtaatcagagac

SEQ ID NO: 41721 - DNA, 16 bp, Artificial Sequence
  synthetic [barcode part1]
ccacctaatagtgttc

SEQ ID NO: 41722 - DNA, 16 bp, Artificial Sequence
  synthetic [barcode part1]
gtgtaacggtcgagac

SEQ ID NO: 41723 - DNA, 16 bp, Artificial Sequence
  synthetic [barcode part1]
gagtccgtatcttgcc

SEQ ID NO: 41724 - DNA, 16 bp, Artificial Sequence
  synthetic [barcode part1]
gtccgtggaagatcag

SEQ ID NO: 41725 - DNA, 16 bp, Artificial Sequence
  synthetic [barcode part1]
tacactctcgtcaagt

SEQ ID NO: 41726 - DNA, 16 bp, Artificial Sequence
  synthetic [barcode part1]
agactaacgtgtaacg

SEQ ID NO: 41727 - DNA, 16 bp, Artificial Sequence
  synthetic [barcode part1]
ttattaggcgtccttg

SEQ ID NO: 41728 - DNA, 16 bp, Artificial Sequence
  synthetic [barcode part1]
caaggagtgcacaacc

SEQ ID NO: 41729 - DNA, 16 bp, Artificial Sequence
  synthetic [barcode part1]
gaaggcgcgaatcgtt

SEQ ID NO: 41730 - DNA, 16 bp, Artificial Sequence
  synthetic [barcode part1]
cacagtactcactcgc

SEQ ID NO: 41731 - DNA, 16 bp, Artificial Sequence
  synthetic [barcode part1]
gtccaataatccggtg

SEQ ID NO: 41732 - DNA, 16 bp, Artificial Sequence
  synthetic [barcode part1]
ttagttccgagtctac

SEQ ID NO: 41733 - DNA, 16 bp, Artificial Sequence
  synthetic [barcode part1]
tcctgtgtcgataatc

SEQ ID NO: 41734 - DNA, 16 bp, Artificial Sequence
  synthetic [barcode part1]
gacgacttcagtgact

SEQ ID NO: 41735 - DNA, 16 bp, Artificial Sequence
  synthetic [barcode part1]
gaactgtagtataggc

SEQ ID NO: 41736 - DNA, 16 bp, Artificial Sequence
  synthetic [barcode part1]
gagtggttgcaccaag

SEQ ID NO: 41737 - DNA, 16 bp, Artificial Sequence
  synthetic [barcode part1]
ccgacgatctagtaac

SEQ ID NO: 41738 - DNA, 16 bp, Artificial Sequence
  synthetic [barcode part1]
atcttactccgacctc

SEQ ID NO: 41739 - DNA, 16 bp, Artificial Sequence
  synthetic [barcode part1]
caactgacaaccagtc

SEQ ID NO: 41740 - DNA, 16 bp, Artificial Sequence
  synthetic [barcode part1]
agacttatccggtctt

SEQ ID NO: 41741 - DNA, 16 bp, Artificial Sequence
  synthetic [barcode part1]
gcgtcgttaagtggag

SEQ ID NO: 41742 - DNA, 16 bp, Artificial Sequence
  synthetic [barcode part1]
tcagttccttgtgagt

SEQ ID NO: 41743 - DNA, 16 bp, Artificial Sequence
  synthetic [barcode part1]
tgttgcaacgtgtacg

SEQ ID NO: 41744 - DNA, 16 bp, Artificial Sequence
  synthetic [barcode part1]
tggcgaacgtctgaag

SEQ ID NO: 41745 - DNA, 16 bp, Artificial Sequence
  synthetic [barcode part1]
ttgaacgatcttgtcc

SEQ ID NO: 41746 - DNA, 16 bp, Artificial Sequence
  synthetic [barcode part1]
taacgtgtacaccgac

SEQ ID NO: 41747 - DNA, 16 bp, Artificial Sequence
  synthetic [barcode part1]
tcttggtctgaacact

SEQ ID NO: 41748 - DNA, 16 bp, Artificial Sequence
  synthetic [barcode part1]
cgtagtggacaggtgt

SEQ ID NO: 41749 - DNA, 16 bp, Artificial Sequence
  synthetic [barcode part1]
taatcttcctcggcct

SEQ ID NO: 41750 - DNA, 16 bp, Artificial Sequence
  synthetic [barcode part1]
cgttgagagacgtggt

SEQ ID NO: 41751 - DNA, 16 bp, Artificial Sequence
  synthetic [barcode part1]
cggactaataccttct

SEQ ID NO: 41752 - DNA, 16 bp, Artificial Sequence
  synthetic [barcode part1]
gttgcgactacaacgt

SEQ ID NO: 41753 - DNA, 16 bp, Artificial Sequence
  synthetic [barcode part1]
cgaagtgacaggatag

SEQ ID NO: 41754 - DNA, 16 bp, Artificial Sequence
  synthetic [barcode part1]
cctggtcttccttagt

SEQ ID NO: 41755 - DNA, 16 bp, Artificial Sequence
  synthetic [barcode part1]
gtacgtactaggactc

SEQ ID NO: 41756 - DNA, 16 bp, Artificial Sequence
  synthetic [barcode part1]
cagtgcgagttatacc

SEQ ID NO: 41757 - DNA, 16 bp, Artificial Sequence
  synthetic [barcode part1]
cgttctctgtatcctg

SEQ ID NO: 41758 - DNA, 16 bp, Artificial Sequence
  synthetic [barcode part1]
cgtaacttctctggcg

SEQ ID NO: 41759 - DNA, 16 bp, Artificial Sequence
  synthetic [barcode part1]
tcgtacaattgacgcg

SEQ ID NO: 41760 - DNA, 16 bp, Artificial Sequence
  synthetic [barcode part1]
tactatctaggcctac

SEQ ID NO: 41761 - DNA, 16 bp, Artificial Sequence
  synthetic [barcode part1]
acaactgatatcggcc

SEQ ID NO: 41762 - DNA, 16 bp, Artificial Sequence
  synthetic [barcode part1]
tccaccggagaattgt

SEQ ID NO: 41763 - DNA, 16 bp, Artificial Sequence
  synthetic [barcode part1]
tattctccgcactctg

SEQ ID NO: 41764 - DNA, 16 bp, Artificial Sequence
  synthetic [barcode part1]
gcgatatcaacaccac

SEQ ID NO: 41765 - DNA, 16 bp, Artificial Sequence
  synthetic [barcode part1]
ttatctccgaccttcg

SEQ ID NO: 41766 - DNA, 16 bp, Artificial Sequence
  synthetic [barcode part1]
agaatctcgtccgcct

SEQ ID NO: 41767 - DNA, 16 bp, Artificial Sequence
  synthetic [barcode part1]
agtgtggtgtctctag

SEQ ID NO: 41768 - DNA, 16 bp, Artificial Sequence
  synthetic [barcode part1]
caggtatccagatacc

SEQ ID NO: 41769 - DNA, 16 bp, Artificial Sequence
  synthetic [barcode part1]
agtgtctggacacttg

SEQ ID NO: 41770 - DNA, 16 bp, Artificial Sequence
  synthetic [barcode part1]
ttatcaacttcgcgtg

SEQ ID NO: 41771 - DNA, 16 bp, Artificial Sequence
  synthetic [barcode part1]
acggaacagtgcctag

SEQ ID NO: 41772 - DNA, 16 bp, Artificial Sequence
  synthetic [barcode part1]
cagatacctggatacc

SEQ ID NO: 41773 - DNA, 16 bp, Artificial Sequence
  synthetic [barcode part1]
gtcgtgatccggaatt

SEQ ID NO: 41774 - DNA, 16 bp, Artificial Sequence
  synthetic [barcode part1]
gtcgacgtagacttac

SEQ ID NO: 41775 - DNA, 16 bp, Artificial Sequence
  synthetic [barcode part1]
aactcttggcctatac

SEQ ID NO: 41776 - DNA, 16 bp, Artificial Sequence
  synthetic [barcode part1]
gcgtccttcggattgt

SEQ ID NO: 41777 - DNA, 16 bp, Artificial Sequence
  synthetic [barcode part1]
gacacactcttagtct

SEQ ID NO: 41778 - DNA, 16 bp, Artificial Sequence
  synthetic [barcode part1]
acaccggattaagaac

SEQ ID NO: 41779 - DNA, 16 bp, Artificial Sequence
  synthetic [barcode part1]
ttgacgtcaacgtgtg

SEQ ID NO: 41780 - DNA, 16 bp, Artificial Sequence
  synthetic [barcode part1]
ttctcctgccacaatc

SEQ ID NO: 41781 - DNA, 16 bp, Artificial Sequence
  synthetic [barcode part1]
agtgactggagtgcac

SEQ ID NO: 41782 - DNA, 16 bp, Artificial Sequence
  synthetic [barcode part1]
tgaccgcgaatattcg

SEQ ID NO: 41783 - DNA, 16 bp, Artificial Sequence
  synthetic [barcode part1]
acgcgatcaactgtgt

SEQ ID NO: 41784 - DNA, 16 bp, Artificial Sequence
  synthetic [barcode part1]
tcacagagtagttgcc

SEQ ID NO: 41785 - DNA, 16 bp, Artificial Sequence
  synthetic [barcode part1]
agagtgacgaacactt

SEQ ID NO: 41786 - DNA, 16 bp, Artificial Sequence
  synthetic [barcode part1]
gaatacaattggaccg

SEQ ID NO: 41787 - DNA, 16 bp, Artificial Sequence
  synthetic [barcode part1]
tactgttgacacactc

SEQ ID NO: 41788 - DNA, 16 bp, Artificial Sequence
  synthetic [barcode part1]
tcaattaccggagtcg

SEQ ID NO: 41789 - DNA, 16 bp, Artificial Sequence
  synthetic [barcode part1]
tgagtctctgtgaacg

SEQ ID NO: 41790 - DNA, 16 bp, Artificial Sequence
  synthetic [barcode part1]
gaagaaccacctcgtt

SEQ ID NO: 41791 - DNA, 16 bp, Artificial Sequence
  synthetic [barcode part1]
aagtcgtccgcacttc

SEQ ID NO: 41792 - DNA, 16 bp, Artificial Sequence
  synthetic [barcode part1]
tgacacggtcgtctct

SEQ ID NO: 41793 - DNA, 16 bp, Artificial Sequence
  synthetic [barcode part1]
gttaccacacacctcg

SEQ ID NO: 41794 - DNA, 16 bp, Artificial Sequence
  synthetic [barcode part1]
gtagaatcgttcgaag

SEQ ID NO: 41795 - DNA, 16 bp, Artificial Sequence
  synthetic [barcode part1]
ttcactaggaacggtc

SEQ ID NO: 41796 - DNA, 16 bp, Artificial Sequence
  synthetic [barcode part1]
cactgccagacgttct

SEQ ID NO: 41797 - DNA, 16 bp, Artificial Sequence
  synthetic [barcode part1]
tgaacaactcaaggtg

SEQ ID NO: 41798 - DNA, 16 bp, Artificial Sequence
  synthetic [barcode part1]
ttaggcggtgacaggt

SEQ ID NO: 41799 - DNA, 16 bp, Artificial Sequence
  synthetic [barcode part1]
aaggtcttacctactc

SEQ ID NO: 41800 - DNA, 16 bp, Artificial Sequence
  synthetic [barcode part1]
gcaacgaagacactcg

SEQ ID NO: 41801 - DNA, 16 bp, Artificial Sequence
  synthetic [barcode part1]
tattcaagtcggagag

SEQ ID NO: 41802 - DNA, 16 bp, Artificial Sequence
  synthetic [barcode part1]
cactagtgttagtgcg

SEQ ID NO: 41803 - DNA, 16 bp, Artificial Sequence
  synthetic [barcode part1]
aggtaggttcaagatc

SEQ ID NO: 41804 - DNA, 16 bp, Artificial Sequence
  synthetic [barcode part1]
aggagtgacagtctgc

SEQ ID NO: 41805 - DNA, 16 bp, Artificial Sequence
  synthetic [barcode part1]
acagtcgtgtacggtt

SEQ ID NO: 41806 - DNA, 16 bp, Artificial Sequence
  synthetic [barcode part1]
tctgaacctattgtcg

SEQ ID NO: 41807 - DNA, 16 bp, Artificial Sequence
  synthetic [barcode part1]
cgcaccttctgtactt

SEQ ID NO: 41808 - DNA, 16 bp, Artificial Sequence
  synthetic [barcode part1]
cacgttcttgccgaac

SEQ ID NO: 41809 - DNA, 16 bp, Artificial Sequence
  synthetic [barcode part1]
ttcgccgttaagtgtt

SEQ ID NO: 41810 - DNA, 16 bp, Artificial Sequence
  synthetic [barcode part1]
tgtggacggtgagact

SEQ ID NO: 41811 - DNA, 16 bp, Artificial Sequence
  synthetic [barcode part1]
attaagtcggaggcgc

SEQ ID NO: 41812 - DNA, 16 bp, Artificial Sequence
  synthetic [barcode part1]
gtatcagatcgagaac

SEQ ID NO: 41813 - DNA, 16 bp, Artificial Sequence
  synthetic [barcode part1]
cagtcaagttagtcgc

SEQ ID NO: 41814 - DNA, 16 bp, Artificial Sequence
  synthetic [barcode part1]
gaaccacacgaggact

SEQ ID NO: 41815 - DNA, 16 bp, Artificial Sequence
  synthetic [barcode part1]
ttccacactagactgt

SEQ ID NO: 41816 - DNA, 16 bp, Artificial Sequence
  synthetic [barcode part1]
agtgcgcgatcttctc

SEQ ID NO: 41817 - DNA, 16 bp, Artificial Sequence
  synthetic [barcode part1]
tacgtagtgccttgcc

SEQ ID NO: 41818 - DNA, 16 bp, Artificial Sequence
  synthetic [barcode part1]
aagaccgtagtccttg

SEQ ID NO: 41819 - DNA, 16 bp, Artificial Sequence
  synthetic [barcode part1]
cactgaattgcgcctc

SEQ ID NO: 41820 - DNA, 16 bp, Artificial Sequence
  synthetic [barcode part1]
aaccgtacgatacgtc

SEQ ID NO: 41821 - DNA, 16 bp, Artificial Sequence
  synthetic [barcode part1]
gcaccaggttaccttc

SEQ ID NO: 41822 - DNA, 16 bp, Artificial Sequence
  synthetic [barcode part1]
tctcgaaggtaggcag

SEQ ID NO: 41823 - DNA, 16 bp, Artificial Sequence
  synthetic [barcode part1]
ttcgttaccgagtgcc

SEQ ID NO: 41824 - DNA, 16 bp, Artificial Sequence
  synthetic [barcode part1]
ccgtatagaggaattg

SEQ ID NO: 41825 - DNA, 16 bp, Artificial Sequence
  synthetic [barcode part1]
gaattcaagaccgagt

SEQ ID NO: 41826 - DNA, 16 bp, Artificial Sequence
  synthetic [barcode part1]
tgactccaagaggttc

SEQ ID NO: 41827 - DNA, 16 bp, Artificial Sequence
  synthetic [barcode part1]
gagtggaggtactacc

SEQ ID NO: 41828 - DNA, 16 bp, Artificial Sequence
  synthetic [barcode part1]
ttcgaaggttaaccgc

SEQ ID NO: 41829 - DNA, 16 bp, Artificial Sequence
  synthetic [barcode part1]
agttcttcgcgtcgac

SEQ ID NO: 41830 - DNA, 16 bp, Artificial Sequence
  synthetic [barcode part1]
ttacgacaggagagag

SEQ ID NO: 41831 - DNA, 16 bp, Artificial Sequence
  synthetic [barcode part1]
gtgtctcttgaatcac

SEQ ID NO: 41832 - DNA, 16 bp, Artificial Sequence
  synthetic [barcode part1]
ccgcactgtaagagtt

SEQ ID NO: 41833 - DNA, 16 bp, Artificial Sequence
  synthetic [barcode part1]
gtcctgttattagtgc

SEQ ID NO: 41834 - DNA, 16 bp, Artificial Sequence
  synthetic [barcode part1]
cgtgaatagatagtgc

SEQ ID NO: 41835 - DNA, 16 bp, Artificial Sequence
  synthetic [barcode part1]
aactgcgcacgattgt

SEQ ID NO: 41836 - DNA, 16 bp, Artificial Sequence
  synthetic [barcode part1]
gtatcggaactgcgtt

SEQ ID NO: 41837 - DNA, 16 bp, Artificial Sequence
  synthetic [barcode part1]
gacacgtgtactggtt

SEQ ID NO: 41838 - DNA, 16 bp, Artificial Sequence
  synthetic [barcode part1]
cacagacgaacctgtt

SEQ ID NO: 41839 - DNA, 16 bp, Artificial Sequence
  synthetic [barcode part1]
ccacaagatcttctgt

SEQ ID NO: 41840 - DNA, 16 bp, Artificial Sequence
  synthetic [barcode part1]
aggtgttgtaggttcc

SEQ ID NO: 41841 - DNA, 16 bp, Artificial Sequence
  synthetic [barcode part1]
attgcacaaggcggtg

SEQ ID NO: 41842 - DNA, 16 bp, Artificial Sequence
  synthetic [barcode part1]
tctgtaccaacaacct

SEQ ID NO: 41843 - DNA, 16 bp, Artificial Sequence
  synthetic [barcode part1]
aggttcgacctgaact

SEQ ID NO: 41844 - DNA, 16 bp, Artificial Sequence
  synthetic [barcode part1]
ttgacgacagagacgc

SEQ ID NO: 41845 - DNA, 16 bp, Artificial Sequence
  synthetic [barcode part1]
aattgtgcctcgactt

SEQ ID NO: 41846 - DNA, 16 bp, Artificial Sequence
  synthetic [barcode part1]
atctctaagtgactcc

SEQ ID NO: 41847 - DNA, 16 bp, Artificial Sequence
  synthetic [barcode part1]
cgaggcgaatacactg

SEQ ID NO: 41848 - DNA, 16 bp, Artificial Sequence
  synthetic [barcode part1]
tcttgccgccttattg

SEQ ID NO: 41849 - DNA, 16 bp, Artificial Sequence
  synthetic [barcode part1]
gtcctcgacagagatt

SEQ ID NO: 41850 - DNA, 16 bp, Artificial Sequence
  synthetic [barcode part1]
atccttgtagaccact

SEQ ID NO: 41851 - DNA, 16 bp, Artificial Sequence
  synthetic [barcode part1]
aactacgcgtagtcac

SEQ ID NO: 41852 - DNA, 16 bp, Artificial Sequence
  synthetic [barcode part1]
atcgttgaacctggtg

SEQ ID NO: 41853 - DNA, 16 bp, Artificial Sequence
  synthetic [barcode part1]
tagttccgcgtcaatt

SEQ ID NO: 41854 - DNA, 16 bp, Artificial Sequence
  synthetic [barcode part1]
aagttaggtgcgccag

SEQ ID NO: 41855 - DNA, 16 bp, Artificial Sequence
  synthetic [barcode part1]
cgagtcctactacctg

SEQ ID NO: 41856 - DNA, 16 bp, Artificial Sequence
  synthetic [barcode part1]
cgcaaccttctattag

SEQ ID NO: 41857 - DNA, 16 bp, Artificial Sequence
  synthetic [barcode part1]
gtctactcctggaatt

SEQ ID NO: 41858 - DNA, 16 bp, Artificial Sequence
  synthetic [barcode part1]
gtctgtcctacctatc

SEQ ID NO: 41859 - DNA, 16 bp, Artificial Sequence
  synthetic [barcode part1]
agtgtgtacacgttgc

SEQ ID NO: 41860 - DNA, 16 bp, Artificial Sequence
  synthetic [barcode part1]
ccgtagaatagagtgt

SEQ ID NO: 41861 - DNA, 16 bp, Artificial Sequence
  synthetic [barcode part1]
agactaacgacgcacg

SEQ ID NO: 41862 - DNA, 16 bp, Artificial Sequence
  synthetic [barcode part1]
gttcgaactcgttgcc

SEQ ID NO: 41863 - DNA, 16 bp, Artificial Sequence
  synthetic [barcode part1]
aacgcacgaagaactt

SEQ ID NO: 41864 - DNA, 16 bp, Artificial Sequence
  synthetic [barcode part1]
tacaggtgagtaacac

SEQ ID NO: 41865 - DNA, 16 bp, Artificial Sequence
  synthetic [barcode part1]
tcggcgttcctaactg

SEQ ID NO: 41866 - DNA, 16 bp, Artificial Sequence
  synthetic [barcode part1]
gcctacttgaggtctc

SEQ ID NO: 41867 - DNA, 16 bp, Artificial Sequence
  synthetic [barcode part1]
taggcactcaacgtgt

SEQ ID NO: 41868 - DNA, 16 bp, Artificial Sequence
  synthetic [barcode part1]
tgatcttgtgtgccgc

SEQ ID NO: 41869 - DNA, 16 bp, Artificial Sequence
  synthetic [barcode part1]
cctatatacgtgaggc

SEQ ID NO: 41870 - DNA, 16 bp, Artificial Sequence
  synthetic [barcode part1]
gttccacgacaacaac

SEQ ID NO: 41871 - DNA, 16 bp, Artificial Sequence
  synthetic [barcode part1]
tgtacacgtacgtacg

SEQ ID NO: 41872 - DNA, 16 bp, Artificial Sequence
  synthetic [barcode part1]
gtaacacgtgttacgc

SEQ ID NO: 41873 - DNA, 16 bp, Artificial Sequence
  synthetic [barcode part1]
gcaacgtgtcaactgt

SEQ ID NO: 41874 - DNA, 16 bp, Artificial Sequence
  synthetic [barcode part1]
gtcgcctctataagtt

SEQ ID NO: 41875 - DNA, 16 bp, Artificial Sequence
  synthetic [barcode part1]
cgagattatacgtgcc

SEQ ID NO: 41876 - DNA, 16 bp, Artificial Sequence
  synthetic [barcode part1]
attccgcctcaacttc

SEQ ID NO: 41877 - DNA, 16 bp, Artificial Sequence
  synthetic [barcode part1]
tgcagtgacttatcct

SEQ ID NO: 41878 - DNA, 16 bp, Artificial Sequence
  synthetic [barcode part1]
tggtcttgttggtgtt

SEQ ID NO: 41879 - DNA, 16 bp, Artificial Sequence
  synthetic [barcode part1]
cctgtgcaactattgt

SEQ ID NO: 41880 - DNA, 16 bp, Artificial Sequence
  synthetic [barcode part1]
gattacgacacactgc

SEQ ID NO: 41881 - DNA, 16 bp, Artificial Sequence
  synthetic [barcode part1]
cctgattccgacttct

SEQ ID NO: 41882 - DNA, 16 bp, Artificial Sequence
  synthetic [barcode part1]
tggtctctagtacgcc

SEQ ID NO: 41883 - DNA, 16 bp, Artificial Sequence
  synthetic [barcode part1]
cacgattaccgttccg

SEQ ID NO: 41884 - DNA, 16 bp, Artificial Sequence
  synthetic [barcode part1]
attcttcgcaccgacg

SEQ ID NO: 41885 - DNA, 16 bp, Artificial Sequence
  synthetic [barcode part1]
ttctaactcctaccgc

SEQ ID NO: 41886 - DNA, 16 bp, Artificial Sequence
  synthetic [barcode part1]
gacaccgatactgtac

SEQ ID NO: 41887 - DNA, 16 bp, Artificial Sequence
  synthetic [barcode part1]
acttgtccggagtcct

SEQ ID NO: 41888 - DNA, 16 bp, Artificial Sequence
  synthetic [barcode part1]
tagtgcggtcgtctct

SEQ ID NO: 41889 - DNA, 16 bp, Artificial Sequence
  synthetic [barcode part1]
actcttgtcgttgagt

SEQ ID NO: 41890 - DNA, 16 bp, Artificial Sequence
  synthetic [barcode part1]
tcgccgagtatcttcg

SEQ ID NO: 41891 - DNA, 16 bp, Artificial Sequence
  synthetic [barcode part1]
tgcgtagagaccgagt

SEQ ID NO: 41892 - DNA, 16 bp, Artificial Sequence
  synthetic [barcode part1]
cgccaaggtagaagtc

SEQ ID NO: 41893 - DNA, 16 bp, Artificial Sequence
  synthetic [barcode part1]
gtagatcgaggcagtc

SEQ ID NO: 41894 - DNA, 16 bp, Artificial Sequence
  synthetic [barcode part1]
attcggattgcagacc

SEQ ID NO: 41895 - DNA, 16 bp, Artificial Sequence
  synthetic [barcode part1]
ttacaggttcgtggac

SEQ ID NO: 41896 - DNA, 16 bp, Artificial Sequence
  synthetic [barcode part1]
agattcgacaatcgcc

SEQ ID NO: 41897 - DNA, 16 bp, Artificial Sequence
  synthetic [barcode part1]
tgcgttcttcggtgac

SEQ ID NO: 41898 - DNA, 16 bp, Artificial Sequence
  synthetic [barcode part1]
actctcgcagagatac

SEQ ID NO: 41899 - DNA, 16 bp, Artificial Sequence
  synthetic [barcode part1]
atcgcggttacgatac

SEQ ID NO: 41900 - DNA, 16 bp, Artificial Sequence
  synthetic [barcode part1]
tcaacgtcctcaattg

SEQ ID NO: 41901 - DNA, 16 bp, Artificial Sequence
  synthetic [barcode part1]
ttctgacgtacctagt

SEQ ID NO: 41902 - DNA, 16 bp, Artificial Sequence
  synthetic [barcode part1]
tggccttataccgacc

SEQ ID NO: 41903 - DNA, 16 bp, Artificial Sequence
  synthetic [barcode part1]
gttgaattgtcctcgt

SEQ ID NO: 41904 - DNA, 16 bp, Artificial Sequence
  synthetic [barcode part1]
ccaaggtgcaatacct

SEQ ID NO: 41905 - DNA, 16 bp, Artificial Sequence
  synthetic [barcode part1]
cgtcacgcaattagtg

SEQ ID NO: 41906 - DNA, 16 bp, Artificial Sequence
  synthetic [barcode part1]
agttagattgcacgag

SEQ ID NO: 41907 - DNA, 16 bp, Artificial Sequence
  synthetic [barcode part1]
tcgaagtcacttatcc

SEQ ID NO: 41908 - DNA, 16 bp, Artificial Sequence
  synthetic [barcode part1]
gaggaatcgttccgtt

SEQ ID NO: 41909 - DNA, 16 bp, Artificial Sequence
  synthetic [barcode part1]
cctcaggatagtgttg

SEQ ID NO: 41910 - DNA, 16 bp, Artificial Sequence
  synthetic [barcode part1]
aatctgcaggttcgtg

SEQ ID NO: 41911 - DNA, 16 bp, Artificial Sequence
  synthetic [barcode part1]
gaggtagttcagatac

SEQ ID NO: 41912 - DNA, 16 bp, Artificial Sequence
  synthetic [barcode part1]
tattacctgtctcgcc

SEQ ID NO: 41913 - DNA, 16 bp, Artificial Sequence
  synthetic [barcode part1]
tgccgacggaactaag

SEQ ID NO: 41914 - DNA, 16 bp, Artificial Sequence
  synthetic [barcode part1]
gtcctgtgttccttac

SEQ ID NO: 41915 - DNA, 16 bp, Artificial Sequence
  synthetic [barcode part1]
caacacaccggtatac

SEQ ID NO: 41916 - DNA, 16 bp, Artificial Sequence
  synthetic [barcode part1]
acacgtgactaaccgt

SEQ ID NO: 41917 - DNA, 16 bp, Artificial Sequence
  synthetic [barcode part1]
cggcctaatccaatag

SEQ ID NO: 41918 - DNA, 16 bp, Artificial Sequence
  synthetic [barcode part1]
tacgcctcagactacc

SEQ ID NO: 41919 - DNA, 16 bp, Artificial Sequence
  synthetic [barcode part1]
acacgcggtactatac

SEQ ID NO: 41920 - DNA, 16 bp, Artificial Sequence
  synthetic [barcode part1]
tctgaccgattggaac

SEQ ID NO: 41921 - DNA, 16 bp, Artificial Sequence
  synthetic [barcode part1]
gcaatcactaaccttc

SEQ ID NO: 41922 - DNA, 16 bp, Artificial Sequence
  synthetic [barcode part1]
tcggtatccgacttcg

SEQ ID NO: 41923 - DNA, 16 bp, Artificial Sequence
  synthetic [barcode part1]
tcgagaggattatacg

SEQ ID NO: 41924 - DNA, 16 bp, Artificial Sequence
  synthetic [barcode part1]
ttgtgccagacacaac

SEQ ID NO: 41925 - DNA, 16 bp, Artificial Sequence
  synthetic [barcode part1]
gattggttggtatcgc

SEQ ID NO: 41926 - DNA, 16 bp, Artificial Sequence
  synthetic [barcode part1]
gtgttccttgaactac

SEQ ID NO: 41927 - DNA, 16 bp, Artificial Sequence
  synthetic [barcode part1]
gtacgataccagtacc

SEQ ID NO: 41928 - DNA, 16 bp, Artificial Sequence
  synthetic [barcode part1]
gcgttcggatacttag

SEQ ID NO: 41929 - DNA, 16 bp, Artificial Sequence
  synthetic [barcode part1]
aggtccgaggttgaac

SEQ ID NO: 41930 - DNA, 16 bp, Artificial Sequence
  synthetic [barcode part1]
accgtagacgatacct

SEQ ID NO: 41931 - DNA, 16 bp, Artificial Sequence
  synthetic [barcode part1]
agtcggaggtgataag

SEQ ID NO: 41932 - DNA, 16 bp, Artificial Sequence
  synthetic [barcode part1]
tgtgtctgacgatctt

SEQ ID NO: 41933 - DNA, 16 bp, Artificial Sequence
  synthetic [barcode part1]
gtcagagtaactacag

SEQ ID NO: 41934 - DNA, 16 bp, Artificial Sequence
  synthetic [barcode part1]
agaattgtcaacgcag

SEQ ID NO: 41935 - DNA, 16 bp, Artificial Sequence
  synthetic [barcode part1]
atcgtcctggaacaac

SEQ ID NO: 41936 - DNA, 16 bp, Artificial Sequence
  synthetic [barcode part1]
agattaggtcggcacg

SEQ ID NO: 41937 - DNA, 16 bp, Artificial Sequence
  synthetic [barcode part1]
ttaggtgcgttcagac

SEQ ID NO: 41938 - DNA, 16 bp, Artificial Sequence
  synthetic [barcode part1]
tcaataactgccaggc

SEQ ID NO: 41939 - DNA, 16 bp, Artificial Sequence
  synthetic [barcode part1]
caagttcgataagacg

SEQ ID NO: 41940 - DNA, 16 bp, Artificial Sequence
  synthetic [barcode part1]
caacgcagagaattgt

SEQ ID NO: 41941 - DNA, 16 bp, Artificial Sequence
  synthetic [barcode part1]
gttaagtcttggcggt

SEQ ID NO: 41942 - DNA, 16 bp, Artificial Sequence
  synthetic [barcode part1]
atcctcacgttgagtt

SEQ ID NO: 41943 - DNA, 16 bp, Artificial Sequence
  synthetic [barcode part1]
gttgttcggtggagtt

SEQ ID NO: 41944 - DNA, 16 bp, Artificial Sequence
  synthetic [barcode part1]
aaggcagtcacggatc

SEQ ID NO: 41945 - DNA, 16 bp, Artificial Sequence
  synthetic [barcode part1]
acctaacctctgcgtg

SEQ ID NO: 41946 - DNA, 16 bp, Artificial Sequence
  synthetic [barcode part1]
atctgttacagtgtcc

SEQ ID NO: 41947 - DNA, 16 bp, Artificial Sequence
  synthetic [barcode part1]
cgtacctatccgacac

SEQ ID NO: 41948 - DNA, 16 bp, Artificial Sequence
  synthetic [barcode part1]
ccaacgaatctggtgt

SEQ ID NO: 41949 - DNA, 16 bp, Artificial Sequence
  synthetic [barcode part1]
tatcgaggatataggc

SEQ ID NO: 41950 - DNA, 16 bp, Artificial Sequence
  synthetic [barcode part1]
cgcaacgtgttgtaac

SEQ ID NO: 41951 - DNA, 16 bp, Artificial Sequence
  synthetic [barcode part1]
tcaccggcctctatag

SEQ ID NO: 41952 - DNA, 16 bp, Artificial Sequence
  synthetic [barcode part1]
atacttcgaccaccgc

SEQ ID NO: 41953 - DNA, 16 bp, Artificial Sequence
  synthetic [barcode part1]
gcgcaataatcagagt

SEQ ID NO: 41954 - DNA, 16 bp, Artificial Sequence
  synthetic [barcode part1]
caatcctcacgattgt

SEQ ID NO: 41955 - DNA, 16 bp, Artificial Sequence
  synthetic [barcode part1]
tacggcgaatactacc

SEQ ID NO: 41956 - DNA, 16 bp, Artificial Sequence
  synthetic [barcode part1]
acttggaggtattcgc

SEQ ID NO: 41957 - DNA, 16 bp, Artificial Sequence
  synthetic [barcode part1]
agtagtcacacaagac

SEQ ID NO: 41958 - DNA, 16 bp, Artificial Sequence
  synthetic [barcode part1]
attaggacggttgtag

SEQ ID NO: 41959 - DNA, 16 bp, Artificial Sequence
  synthetic [barcode part1]
taacggttcggactac

SEQ ID NO: 41960 - DNA, 16 bp, Artificial Sequence
  synthetic [barcode part1]
caagactgtgtcgtac

SEQ ID NO: 41961 - DNA, 16 bp, Artificial Sequence
  synthetic [barcode part1]
aatacgtaaccggagt

SEQ ID NO: 41962 - DNA, 16 bp, Artificial Sequence
  synthetic [barcode part1]
gcgtctcgattaccgt

SEQ ID NO: 41963 - DNA, 16 bp, Artificial Sequence
  synthetic [barcode part1]
tgcaatctctctaacg

SEQ ID NO: 41964 - DNA, 16 bp, Artificial Sequence
  synthetic [barcode part1]
agaattgcacgagttg

SEQ ID NO: 41965 - DNA, 16 bp, Artificial Sequence
  synthetic [barcode part1]
tcttacaccagatcac

SEQ ID NO: 41966 - DNA, 16 bp, Artificial Sequence
  synthetic [barcode part1]
ccagtctgacgataac

SEQ ID NO: 41967 - DNA, 16 bp, Artificial Sequence
  synthetic [barcode part1]
gagtatcgcaacggac

SEQ ID NO: 41968 - DNA, 16 bp, Artificial Sequence
  synthetic [barcode part1]
cgcctatacttacctc

SEQ ID NO: 41969 - DNA, 16 bp, Artificial Sequence
  synthetic [barcode part1]
aacacgttggttgcac

SEQ ID NO: 41970 - DNA, 16 bp, Artificial Sequence
  synthetic [barcode part1]
cgagtacttctcaact

SEQ ID NO: 41971 - DNA, 16 bp, Artificial Sequence
  synthetic [barcode part1]
cagtgcgtctcgttac

SEQ ID NO: 41972 - DNA, 16 bp, Artificial Sequence
  synthetic [barcode part1]
tatcggtcacgatcag

SEQ ID NO: 41973 - DNA, 16 bp, Artificial Sequence
  synthetic [barcode part1]
gagttaccgaactgtc

SEQ ID NO: 41974 - DNA, 16 bp, Artificial Sequence
  synthetic [barcode part1]
gacctctgagatagtc

SEQ ID NO: 41975 - DNA, 16 bp, Artificial Sequence
  synthetic [barcode part1]
tattcggtgataggag

SEQ ID NO: 41976 - DNA, 16 bp, Artificial Sequence
  synthetic [barcode part1]
acttctggcagagact

SEQ ID NO: 41977 - DNA, 16 bp, Artificial Sequence
  synthetic [barcode part1]
agacgaaccgtctgtt

SEQ ID NO: 41978 - DNA, 16 bp, Artificial Sequence
  synthetic [barcode part1]
tcaccactaggcgttc

SEQ ID NO: 41979 - DNA, 16 bp, Artificial Sequence
  synthetic [barcode part1]
gaacgttatccgcaac

SEQ ID NO: 41980 - DNA, 16 bp, Artificial Sequence
  synthetic [barcode part1]
cgacaatactaggtcc

SEQ ID NO: 41981 - DNA, 16 bp, Artificial Sequence
  synthetic [barcode part1]
tcctagtcggttcctt

SEQ ID NO: 41982 - DNA, 16 bp, Artificial Sequence
  synthetic [barcode part1]
tgttcacgttcgtcct

SEQ ID NO: 41983 - DNA, 16 bp, Artificial Sequence
  synthetic [barcode part1]
atatcaacggttctcc

SEQ ID NO: 41984 - DNA, 16 bp, Artificial Sequence
  synthetic [barcode part1]
cgtggactagatatcc

SEQ ID NO: 41985 - DNA, 16 bp, Artificial Sequence
  synthetic [barcode part1]
aaccggtagagaaggt

SEQ ID NO: 41986 - DNA, 16 bp, Artificial Sequence
  synthetic [barcode part1]
acgtgaggtagtccag

SEQ ID NO: 41987 - DNA, 16 bp, Artificial Sequence
  synthetic [barcode part1]
acttacctcgtccgtt

SEQ ID NO: 41988 - DNA, 16 bp, Artificial Sequence
  synthetic [barcode part1]
gaggacgtattgagtt

SEQ ID NO: 41989 - DNA, 16 bp, Artificial Sequence
  synthetic [barcode part1]
gcagtcaggttgaggt

SEQ ID NO: 41990 - DNA, 16 bp, Artificial Sequence
  synthetic [barcode part1]
taggcgaacggataag

SEQ ID NO: 41991 - DNA, 16 bp, Artificial Sequence
  synthetic [barcode part1]
ccagtagttcaacggt

SEQ ID NO: 41992 - DNA, 16 bp, Artificial Sequence
  synthetic [barcode part1]
tgtggacctgtaggtt

SEQ ID NO: 41993 - DNA, 16 bp, Artificial Sequence
  synthetic [barcode part1]
ttccgcacaattcggc

SEQ ID NO: 41994 - DNA, 16 bp, Artificial Sequence
  synthetic [barcode part1]
tacggcactacttgtt

SEQ ID NO: 41995 - DNA, 16 bp, Artificial Sequence
  synthetic [barcode part1]
gacaggaattgaaggc

SEQ ID NO: 41996 - DNA, 16 bp, Artificial Sequence
  synthetic [barcode part1]
caatcaggtaccacac

SEQ ID NO: 41997 - DNA, 16 bp, Artificial Sequence
  synthetic [barcode part1]
gcgaagatcgagtcac

SEQ ID NO: 41998 - DNA, 16 bp, Artificial Sequence
  synthetic [barcode part1]
agtcgttctgtcgaag

SEQ ID NO: 41999 - DNA, 16 bp, Artificial Sequence
  synthetic [barcode part1]
tagtattctgttcgcg

SEQ ID NO: 42000 - DNA, 16 bp, Artificial Sequence
  synthetic [barcode part1]
agagttaacgcctaag

SEQ ID NO: 42001 - DNA, 16 bp, Artificial Sequence
  synthetic [barcode part1]
gacgtcgcaattaacc

SEQ ID NO: 42002 - DNA, 16 bp, Artificial Sequence
  synthetic [barcode part1]
gtgcgatccaacctct

SEQ ID NO: 42003 - DNA, 16 bp, Artificial Sequence
  synthetic [barcode part1]
ttgtgaggtagagtac

SEQ ID NO: 42004 - DNA, 16 bp, Artificial Sequence
  synthetic [barcode part1]
ccggtgtaattaagag

SEQ ID NO: 42005 - DNA, 16 bp, Artificial Sequence
  synthetic [barcode part1]
tcttacacacgtcctc

SEQ ID NO: 42006 - DNA, 16 bp, Artificial Sequence
  synthetic [barcode part1]
aggaacggtgaagatc

SEQ ID NO: 42007 - DNA, 16 bp, Artificial Sequence
  synthetic [barcode part1]
gttctatctcggttcc

SEQ ID NO: 42008 - DNA, 16 bp, Artificial Sequence
  synthetic [barcode part1]
ccgagtagatatccgt

SEQ ID NO: 42009 - DNA, 16 bp, Artificial Sequence
  synthetic [barcode part1]
taggtacttctcaacc

SEQ ID NO: 42010 - DNA, 16 bp, Artificial Sequence
  synthetic [barcode part1]
gtgccgtataacgttg

SEQ ID NO: 42011 - DNA, 16 bp, Artificial Sequence
  synthetic [barcode part1]
taccaactggttgcag

SEQ ID NO: 42012 - DNA, 16 bp, Artificial Sequence
  synthetic [barcode part1]
cgtcaggtaagagtgc

SEQ ID NO: 42013 - DNA, 16 bp, Artificial Sequence
  synthetic [barcode part1]
attaggaactacgcag

SEQ ID NO: 42014 - DNA, 16 bp, Artificial Sequence
  synthetic [barcode part1]
gatcagtcctcagaac

SEQ ID NO: 42015 - DNA, 16 bp, Artificial Sequence
  synthetic [barcode part1]
tcacgaggatagtagt

SEQ ID NO: 42016 - DNA, 16 bp, Artificial Sequence
  synthetic [barcode part1]
caacggttgcgtctct

SEQ ID NO: 42017 - DNA, 16 bp, Artificial Sequence
  synthetic [barcode part1]
gacggatctgcaacag

SEQ ID NO: 42018 - DNA, 16 bp, Artificial Sequence
  synthetic [barcode part1]
gtaccttgttaggtct

SEQ ID NO: 42019 - DNA, 16 bp, Artificial Sequence
  synthetic [barcode part1]
gtcaatcaatcggtcg

SEQ ID NO: 42020 - DNA, 16 bp, Artificial Sequence
  synthetic [barcode part1]
gcagtccttgtacctg

SEQ ID NO: 42021 - DNA, 16 bp, Artificial Sequence
  synthetic [barcode part1]
ccaataccgactacag

SEQ ID NO: 42022 - DNA, 16 bp, Artificial Sequence
  synthetic [barcode part1]
tgcgcaactattacct

SEQ ID NO: 42023 - DNA, 16 bp, Artificial Sequence
  synthetic [barcode part1]
cgttatccacctcact

SEQ ID NO: 42024 - DNA, 16 bp, Artificial Sequence
  synthetic [barcode part1]
aaggttaggtcgtgcg

SEQ ID NO: 42025 - DNA, 16 bp, Artificial Sequence
  synthetic [barcode part1]
tacacactcagagtcg

SEQ ID NO: 42026 - DNA, 16 bp, Artificial Sequence
  synthetic [barcode part1]
actgcagagtaggcgt

SEQ ID NO: 42027 - DNA, 16 bp, Artificial Sequence
  synthetic [barcode part1]
agtctgaactgagtcc

SEQ ID NO: 42028 - DNA, 16 bp, Artificial Sequence
  synthetic [barcode part1]
tgtccacaggtctcac

SEQ ID NO: 42029 - DNA, 16 bp, Artificial Sequence
  synthetic [barcode part1]
taagagtgcaacctag

SEQ ID NO: 42030 - DNA, 16 bp, Artificial Sequence
  synthetic [barcode part1]
tctaactcttctcggc

SEQ ID NO: 42031 - DNA, 16 bp, Artificial Sequence
  synthetic [barcode part1]
gccttcggtctaacgt

SEQ ID NO: 42032 - DNA, 16 bp, Artificial Sequence
  synthetic [barcode part1]
agtaagttctgagacg

SEQ ID NO: 42033 - DNA, 16 bp, Artificial Sequence
  synthetic [barcode part1]
tccaattgtcacgtac

SEQ ID NO: 42034 - DNA, 16 bp, Artificial Sequence
  synthetic [barcode part1]
acagtcaactgacacc

SEQ ID NO: 42035 - DNA, 16 bp, Artificial Sequence
  synthetic [barcode part1]
atcgcgaggacgagtt

SEQ ID NO: 42036 - DNA, 16 bp, Artificial Sequence
  synthetic [barcode part1]
gtccttcggaactaag

SEQ ID NO: 42037 - DNA, 16 bp, Artificial Sequence
  synthetic [barcode part1]
ccggacgatagtaggt

SEQ ID NO: 42038 - DNA, 16 bp, Artificial Sequence
  synthetic [barcode part1]
taaggtcttccaggac

SEQ ID NO: 42039 - DNA, 16 bp, Artificial Sequence
  synthetic [barcode part1]
gtccgactccttgtag

SEQ ID NO: 42040 - DNA, 16 bp, Artificial Sequence
  synthetic [barcode part1]
tcgttgactctacgcg

SEQ ID NO: 42041 - DNA, 16 bp, Artificial Sequence
  synthetic [barcode part1]
caatagaactcacgag

SEQ ID NO: 42042 - DNA, 16 bp, Artificial Sequence
  synthetic [barcode part1]
ccagaagaatcgcgtg

SEQ ID NO: 42043 - DNA, 16 bp, Artificial Sequence
  synthetic [barcode part1]
ccaaggagaaggttag

SEQ ID NO: 42044 - DNA, 16 bp, Artificial Sequence
  synthetic [barcode part1]
gttccggttaaggttg

SEQ ID NO: 42045 - DNA, 16 bp, Artificial Sequence
  synthetic [barcode part1]
tacacacgtactgcag

SEQ ID NO: 42046 - DNA, 16 bp, Artificial Sequence
  synthetic [barcode part1]
tagacgtcgtatcgac

SEQ ID NO: 42047 - DNA, 16 bp, Artificial Sequence
  synthetic [barcode part1]
ttcagtgacgaggacg

SEQ ID NO: 42048 - DNA, 16 bp, Artificial Sequence
  synthetic [barcode part1]
ttggcgatcgttaggt

SEQ ID NO: 42049 - DNA, 16 bp, Artificial Sequence
  synthetic [barcode part1]
aaggaagtaactggcg

SEQ ID NO: 42050 - DNA, 16 bp, Artificial Sequence
  synthetic [barcode part1]
tctcgtaaccagactt

SEQ ID NO: 42051 - DNA, 16 bp, Artificial Sequence
  synthetic [barcode part1]
gacacttgtagttgcg

SEQ ID NO: 42052 - DNA, 16 bp, Artificial Sequence
  synthetic [barcode part1]
ccaggtgatagatctc

SEQ ID NO: 42053 - DNA, 16 bp, Artificial Sequence
  synthetic [barcode part1]
ttgttaaccaacggcg

SEQ ID NO: 42054 - DNA, 16 bp, Artificial Sequence
  synthetic [barcode part1]
gtattggttctactgc

SEQ ID NO: 42055 - DNA, 16 bp, Artificial Sequence
  synthetic [barcode part1]
agaacctaacaagtgc

SEQ ID NO: 42056 - DNA, 16 bp, Artificial Sequence
  synthetic [barcode part1]
cacgttcgaatcgtcc

SEQ ID NO: 42057 - DNA, 16 bp, Artificial Sequence
  synthetic [barcode part1]
tatagttcggtccttg

SEQ ID NO: 42058 - DNA, 16 bp, Artificial Sequence
  synthetic [barcode part1]
gcagtcagtcagtact

SEQ ID NO: 42059 - DNA, 16 bp, Artificial Sequence
  synthetic [barcode part1]
taccaacacacaccag

SEQ ID NO: 42060 - DNA, 16 bp, Artificial Sequence
  synthetic [barcode part1]
tcgaccttaagtctac

SEQ ID NO: 42061 - DNA, 16 bp, Artificial Sequence
  synthetic [barcode part1]
cggcaacacgttcttc

SEQ ID NO: 42062 - DNA, 16 bp, Artificial Sequence
  synthetic [barcode part1]
gatactcacctgaacg

SEQ ID NO: 42063 - DNA, 16 bp, Artificial Sequence
  synthetic [barcode part1]
tgtcaggaagtgtagt

SEQ ID NO: 42064 - DNA, 16 bp, Artificial Sequence
  synthetic [barcode part1]
gtcaaggtacagttag

SEQ ID NO: 42065 - DNA, 16 bp, Artificial Sequence
  synthetic [barcode part1]
ttccacgatactctcc

SEQ ID NO: 42066 - DNA, 16 bp, Artificial Sequence
  synthetic [barcode part1]
gtcacgcctcttaacg

SEQ ID NO: 42067 - DNA, 16 bp, Artificial Sequence
  synthetic [barcode part1]
gaagttcgtctgcctc

SEQ ID NO: 42068 - DNA, 16 bp, Artificial Sequence
  synthetic [barcode part1]
gaatagtgtgcggtcg

SEQ ID NO: 42069 - DNA, 16 bp, Artificial Sequence
  synthetic [barcode part1]
tgagtactgcaagtcc

SEQ ID NO: 42070 - DNA, 16 bp, Artificial Sequence
  synthetic [barcode part1]
gcgagaggtcgaactt

SEQ ID NO: 42071 - DNA, 16 bp, Artificial Sequence
  synthetic [barcode part1]
aataggattaggcacc

SEQ ID NO: 42072 - DNA, 16 bp, Artificial Sequence
  synthetic [barcode part1]
ccttgtacgactcggt

SEQ ID NO: 42073 - DNA, 16 bp, Artificial Sequence
  synthetic [barcode part1]
ttccagaagtgaacag

SEQ ID NO: 42074 - DNA, 16 bp, Artificial Sequence
  synthetic [barcode part1]
aggagattctgtaggt

SEQ ID NO: 42075 - DNA, 16 bp, Artificial Sequence
  synthetic [barcode part1]
tgtctattccgtccac

SEQ ID NO: 42076 - DNA, 16 bp, Artificial Sequence
  synthetic [barcode part1]
tgtaacgcgaacaggc

SEQ ID NO: 42077 - DNA, 16 bp, Artificial Sequence
  synthetic [barcode part1]
tattctgtacctggac

SEQ ID NO: 42078 - DNA, 16 bp, Artificial Sequence
  synthetic [barcode part1]
cacagagtagtggtcg

SEQ ID NO: 42079 - DNA, 16 bp, Artificial Sequence
  synthetic [barcode part1]
agaatctgtaggtggt

SEQ ID NO: 42080 - DNA, 16 bp, Artificial Sequence
  synthetic [barcode part1]
tccgtatagttcggtt

SEQ ID NO: 42081 - DNA, 16 bp, Artificial Sequence
  synthetic [barcode part1]
agttcgagtcaccaac

SEQ ID NO: 42082 - DNA, 16 bp, Artificial Sequence
  synthetic [barcode part1]
ccgtaggcagagaatc

SEQ ID NO: 42083 - DNA, 16 bp, Artificial Sequence
  synthetic [barcode part1]
atactgcgaacggacg

SEQ ID NO: 42084 - DNA, 16 bp, Artificial Sequence
  synthetic [barcode part1]
tgtattcgtccggcac

SEQ ID NO: 42085 - DNA, 16 bp, Artificial Sequence
  synthetic [barcode part1]
ccgtcgttaagacagt

SEQ ID NO: 42086 - DNA, 16 bp, Artificial Sequence
  synthetic [barcode part1]
attgcctggcgttcgt

SEQ ID NO: 42087 - DNA, 16 bp, Artificial Sequence
  synthetic [barcode part1]
cgcagacgagtgatac

SEQ ID NO: 42088 - DNA, 16 bp, Artificial Sequence
  synthetic [barcode part1]
ttccgtctgttatccg

SEQ ID NO: 42089 - DNA, 16 bp, Artificial Sequence
  synthetic [barcode part1]
atacggtaccgtacac

SEQ ID NO: 42090 - DNA, 16 bp, Artificial Sequence
  synthetic [barcode part1]
tggagactgttggacg

SEQ ID NO: 42091 - DNA, 16 bp, Artificial Sequence
  synthetic [barcode part1]
agtctacgtctgtgag

SEQ ID NO: 42092 - DNA, 16 bp, Artificial Sequence
  synthetic [barcode part1]
taagagtaggttaccg

SEQ ID NO: 42093 - DNA, 16 bp, Artificial Sequence
  synthetic [barcode part1]
accgtattgtaggtcg

SEQ ID NO: 42094 - DNA, 16 bp, Artificial Sequence
  synthetic [barcode part1]
tattccgcaccgtctt

SEQ ID NO: 42095 - DNA, 16 bp, Artificial Sequence
  synthetic [barcode part1]
cgcctcgatcttattc

SEQ ID NO: 42096 - DNA, 16 bp, Artificial Sequence
  synthetic [barcode part1]
tgtccgcctcaggatt

SEQ ID NO: 42097 - DNA, 16 bp, Artificial Sequence
  synthetic [barcode part1]
acctaactggcgattg

SEQ ID NO: 42098 - DNA, 16 bp, Artificial Sequence
  synthetic [barcode part1]
gattctgtagacagag

SEQ ID NO: 42099 - DNA, 16 bp, Artificial Sequence
  synthetic [barcode part1]
actcgaatcgccttgc

SEQ ID NO: 42100 - DNA, 16 bp, Artificial Sequence
  synthetic [barcode part1]
tattggcgtgcgttag

SEQ ID NO: 42101 - DNA, 16 bp, Artificial Sequence
  synthetic [barcode part1]
aactgtaagaggacct

SEQ ID NO: 42102 - DNA, 16 bp, Artificial Sequence
  synthetic [barcode part1]
caagtggttatccgtg

SEQ ID NO: 42103 - DNA, 16 bp, Artificial Sequence
  synthetic [barcode part1]
cgttattggaccgaac

SEQ ID NO: 42104 - DNA, 16 bp, Artificial Sequence
  synthetic [barcode part1]
gtggaggccggtaatt

SEQ ID NO: 42105 - DNA, 16 bp, Artificial Sequence
  synthetic [barcode part1]
tagagtaacaactgcg

SEQ ID NO: 42106 - DNA, 16 bp, Artificial Sequence
  synthetic [barcode part1]
gcgtgtctgaagagtg

SEQ ID NO: 42107 - DNA, 16 bp, Artificial Sequence
  synthetic [barcode part1]
tgcaactgttaaggag

SEQ ID NO: 42108 - DNA, 16 bp, Artificial Sequence
  synthetic [barcode part1]
gaattgacgtgatcag

SEQ ID NO: 42109 - DNA, 16 bp, Artificial Sequence
  synthetic [barcode part1]
gtgttctggttcaact

SEQ ID NO: 42110 - DNA, 16 bp, Artificial Sequence
  synthetic [barcode part1]
tacttgttgttgtggc

SEQ ID NO: 42111 - DNA, 16 bp, Artificial Sequence
  synthetic [barcode part1]
tatcaggacctgacac

SEQ ID NO: 42112 - DNA, 16 bp, Artificial Sequence
  synthetic [barcode part1]
atcactcctgttccgt

SEQ ID NO: 42113 - DNA, 16 bp, Artificial Sequence
  synthetic [barcode part1]
agaagatctacgtgac

SEQ ID NO: 42114 - DNA, 16 bp, Artificial Sequence
  synthetic [barcode part1]
agtccaacaacctgac

SEQ ID NO: 42115 - DNA, 16 bp, Artificial Sequence
  synthetic [barcode part1]
cagagttgccagttac

SEQ ID NO: 42116 - DNA, 16 bp, Artificial Sequence
  synthetic [barcode part1]
gtggagtagtgtccag

SEQ ID NO: 42117 - DNA, 16 bp, Artificial Sequence
  synthetic [barcode part1]
tgagaggacgtactgc

SEQ ID NO: 42118 - DNA, 16 bp, Artificial Sequence
  synthetic [barcode part1]
ttccaattgcgccgac

SEQ ID NO: 42119 - DNA, 16 bp, Artificial Sequence
  synthetic [barcode part1]
cagaattgccgactgt

SEQ ID NO: 42120 - DNA, 16 bp, Artificial Sequence
  synthetic [barcode part1]
tccgttccacttgttg

SEQ ID NO: 42121 - DNA, 16 bp, Artificial Sequence
  synthetic [barcode part1]
gagacaggtagtagac

SEQ ID NO: 42122 - DNA, 16 bp, Artificial Sequence
  synthetic [barcode part1]
gcctaggttgtcttgc

SEQ ID NO: 42123 - DNA, 16 bp, Artificial Sequence
  synthetic [barcode part1]
tataggcgtcttgttc

SEQ ID NO: 42124 - DNA, 16 bp, Artificial Sequence
  synthetic [barcode part1]
aacctgtcttggacag

SEQ ID NO: 42125 - DNA, 16 bp, Artificial Sequence
  synthetic [barcode part1]
cagtatccagaacctg

SEQ ID NO: 42126 - DNA, 16 bp, Artificial Sequence
  synthetic [barcode part1]
cagaatcttcctcctc

SEQ ID NO: 42127 - DNA, 16 bp, Artificial Sequence
  synthetic [barcode part1]
gatatcgtgacgtcac

SEQ ID NO: 42128 - DNA, 16 bp, Artificial Sequence
  synthetic [barcode part1]
agagtcgatacgattg

SEQ ID NO: 42129 - DNA, 16 bp, Artificial Sequence
  synthetic [barcode part1]
gattgcgataccgact

SEQ ID NO: 42130 - DNA, 16 bp, Artificial Sequence
  synthetic [barcode part1]
aatcttcgaagaccgc

SEQ ID NO: 42131 - DNA, 16 bp, Artificial Sequence
  synthetic [barcode part1]
ttggcgcgactagaag

SEQ ID NO: 42132 - DNA, 16 bp, Artificial Sequence
  synthetic [barcode part1]
tactggagaacgtggc

SEQ ID NO: 42133 - DNA, 16 bp, Artificial Sequence
  synthetic [barcode part1]
ttggtggcggattact

SEQ ID NO: 42134 - DNA, 16 bp, Artificial Sequence
  synthetic [barcode part1]
ttccttaagacgtctg

SEQ ID NO: 42135 - DNA, 16 bp, Artificial Sequence
  synthetic [barcode part1]
gactgtaggtctcctc

SEQ ID NO: 42136 - DNA, 16 bp, Artificial Sequence
  synthetic [barcode part1]
gtcgaatatcctcgcc

SEQ ID NO: 42137 - DNA, 16 bp, Artificial Sequence
  synthetic [barcode part1]
ttaggacaggcagacc

SEQ ID NO: 42138 - DNA, 16 bp, Artificial Sequence
  synthetic [barcode part1]
gtctgtcacaatatcc

SEQ ID NO: 42139 - DNA, 16 bp, Artificial Sequence
  synthetic [barcode part1]
gactacgttggttctt

SEQ ID NO: 42140 - DNA, 16 bp, Artificial Sequence
  synthetic [barcode part1]
tgacgttgtggtactg

SEQ ID NO: 42141 - DNA, 16 bp, Artificial Sequence
  synthetic [barcode part1]
cgtcaccggtatacct

SEQ ID NO: 42142 - DNA, 16 bp, Artificial Sequence
  synthetic [barcode part1]
tgactctcacggtcgt

SEQ ID NO: 42143 - DNA, 16 bp, Artificial Sequence
  synthetic [barcode part1]
caccactgacgtatcc

SEQ ID NO: 42144 - DNA, 16 bp, Artificial Sequence
  synthetic [barcode part1]
cacacgagacagtggt

SEQ ID NO: 42145 - DNA, 16 bp, Artificial Sequence
  synthetic [barcode part1]
tacaaccaccaagaag

SEQ ID NO: 42146 - DNA, 16 bp, Artificial Sequence
  synthetic [barcode part1]
gtactgatacgttggc

SEQ ID NO: 42147 - DNA, 16 bp, Artificial Sequence
  synthetic [barcode part1]
acaggtcaggatagtt

SEQ ID NO: 42148 - DNA, 16 bp, Artificial Sequence
  synthetic [barcode part1]
ttacaccaacgcaggt

SEQ ID NO: 42149 - DNA, 16 bp, Artificial Sequence
  synthetic [barcode part1]
ttcggcgttacacctg

SEQ ID NO: 42150 - DNA, 16 bp, Artificial Sequence
  synthetic [barcode part1]
taagaacgacaatccg

SEQ ID NO: 42151 - DNA, 16 bp, Artificial Sequence
  synthetic [barcode part1]
ttcttctccggagtct

SEQ ID NO: 42152 - DNA, 16 bp, Artificial Sequence
  synthetic [barcode part1]
agtaggcacggtactg

SEQ ID NO: 42153 - DNA, 16 bp, Artificial Sequence
  synthetic [barcode part1]
ttcgtaccgtagaggt

SEQ ID NO: 42154 - DNA, 16 bp, Artificial Sequence
  synthetic [barcode part1]
atctaggaggtgatac

SEQ ID NO: 42155 - DNA, 16 bp, Artificial Sequence
  synthetic [barcode part1]
gtgattgtgatcacgc

SEQ ID NO: 42156 - DNA, 16 bp, Artificial Sequence
  synthetic [barcode part1]
tgtagtctcgaacacg

SEQ ID NO: 42157 - DNA, 16 bp, Artificial Sequence
  synthetic [barcode part1]
gttgttctgtctgagt

SEQ ID NO: 42158 - DNA, 16 bp, Artificial Sequence
  synthetic [barcode part1]
gttacctcaggcacct

SEQ ID NO: 42159 - DNA, 16 bp, Artificial Sequence
  synthetic [barcode part1]
tgatacaagaggtcgt

SEQ ID NO: 42160 - DNA, 16 bp, Artificial Sequence
  synthetic [barcode part1]
tgtgaatatcctgcct

SEQ ID NO: 42161 - DNA, 16 bp, Artificial Sequence
  synthetic [barcode part1]
aatagacacgataccg

SEQ ID NO: 42162 - DNA, 16 bp, Artificial Sequence
  synthetic [barcode part1]
gttgacttgaccaacg

SEQ ID NO: 42163 - DNA, 16 bp, Artificial Sequence
  synthetic [barcode part1]
taacgcgtcagtacgt

SEQ ID NO: 42164 - DNA, 16 bp, Artificial Sequence
  synthetic [barcode part1]
gattattaggcgcaag

SEQ ID NO: 42165 - DNA, 16 bp, Artificial Sequence
  synthetic [barcode part1]
agttccacacttgttg

SEQ ID NO: 42166 - DNA, 16 bp, Artificial Sequence
  synthetic [barcode part1]
tgaggagtgtgatcgc

SEQ ID NO: 42167 - DNA, 16 bp, Artificial Sequence
  synthetic [barcode part1]
aatccagaggacgtgc

SEQ ID NO: 42168 - DNA, 16 bp, Artificial Sequence
  synthetic [barcode part1]
tggcctgaacgtgaag

SEQ ID NO: 42169 - DNA, 16 bp, Artificial Sequence
  synthetic [barcode part1]
tgaatcacacgttcct

SEQ ID NO: 42170 - DNA, 16 bp, Artificial Sequence
  synthetic [barcode part1]
aagttgaactacgcag

SEQ ID NO: 42171 - DNA, 16 bp, Artificial Sequence
  synthetic [barcode part1]
ccgtcgaacgtaagag

SEQ ID NO: 42172 - DNA, 16 bp, Artificial Sequence
  synthetic [barcode part1]
gtaggtctgtagacct

SEQ ID NO: 42173 - DNA, 16 bp, Artificial Sequence
  synthetic [barcode part1]
atctggaccactctgc

SEQ ID NO: 42174 - DNA, 16 bp, Artificial Sequence
  synthetic [barcode part1]
tgataccttcgagacg

SEQ ID NO: 42175 - DNA, 16 bp, Artificial Sequence
  synthetic [barcode part1]
tgttactgtgactacc

SEQ ID NO: 42176 - DNA, 16 bp, Artificial Sequence
  synthetic [barcode part1]
attaggtaggtacggt

SEQ ID NO: 42177 - DNA, 16 bp, Artificial Sequence
  synthetic [barcode part1]
gaacgtggtatcttcg

SEQ ID NO: 42178 - DNA, 16 bp, Artificial Sequence
  synthetic [barcode part1]
gtattggagtcacacc

SEQ ID NO: 42179 - DNA, 16 bp, Artificial Sequence
  synthetic [barcode part1]
gttggtgacctcctgt

SEQ ID NO: 42180 - DNA, 16 bp, Artificial Sequence
  synthetic [barcode part1]
agtgtcttcacacgag

SEQ ID NO: 42181 - DNA, 16 bp, Artificial Sequence
  synthetic [barcode part1]
aaggcggtcgcagatt

SEQ ID NO: 42182 - DNA, 16 bp, Artificial Sequence
  synthetic [barcode part1]
cctgaggaattctgac

SEQ ID NO: 42183 - DNA, 16 bp, Artificial Sequence
  synthetic [barcode part1]
ttccacgagagtgtac

SEQ ID NO: 42184 - DNA, 16 bp, Artificial Sequence
  synthetic [barcode part1]
gtccaaggaacctgtt

SEQ ID NO: 42185 - DNA, 16 bp, Artificial Sequence
  synthetic [barcode part1]
aactcctgagacgact

SEQ ID NO: 42186 - DNA, 16 bp, Artificial Sequence
  synthetic [barcode part1]
ccgcctgttacagtac

SEQ ID NO: 42187 - DNA, 16 bp, Artificial Sequence
  synthetic [barcode part1]
gtgacactgacactgt

SEQ ID NO: 42188 - DNA, 16 bp, Artificial Sequence
  synthetic [barcode part1]
acctcgtggtgataac

SEQ ID NO: 42189 - DNA, 16 bp, Artificial Sequence
  synthetic [barcode part1]
gattcaagtcggacct

SEQ ID NO: 42190 - DNA, 16 bp, Artificial Sequence
  synthetic [barcode part1]
tagaagattggcctcc

SEQ ID NO: 42191 - DNA, 16 bp, Artificial Sequence
  synthetic [barcode part1]
atccgcgttaagtacg

SEQ ID NO: 42192 - DNA, 16 bp, Artificial Sequence
  synthetic [barcode part1]
cgacctgattctcgtg

SEQ ID NO: 42193 - DNA, 16 bp, Artificial Sequence
  synthetic [barcode part1]
actctgttcacgtagt

SEQ ID NO: 42194 - DNA, 16 bp, Artificial Sequence
  synthetic [barcode part1]
tgacgtactagtgcac

SEQ ID NO: 42195 - DNA, 16 bp, Artificial Sequence
  synthetic [barcode part1]
gtataagtcgtcagag

SEQ ID NO: 42196 - DNA, 16 bp, Artificial Sequence
  synthetic [barcode part1]
gtatcaagtcgttcct

SEQ ID NO: 42197 - DNA, 16 bp, Artificial Sequence
  synthetic [barcode part1]
gacttgatcggatcac

SEQ ID NO: 42198 - DNA, 16 bp, Artificial Sequence
  synthetic [barcode part1]
tgtatctggattgtcc

SEQ ID NO: 42199 - DNA, 16 bp, Artificial Sequence
  synthetic [barcode part1]
cgtatccaacaattcc

SEQ ID NO: 42200 - DNA, 16 bp, Artificial Sequence
  synthetic [barcode part1]
gaccagaacttcctag

SEQ ID NO: 42201 - DNA, 16 bp, Artificial Sequence
  synthetic [barcode part1]
atcctatcctgactcc

SEQ ID NO: 42202 - DNA, 16 bp, Artificial Sequence
  synthetic [barcode part1]
gacgtacgtcagtgtt

SEQ ID NO: 42203 - DNA, 16 bp, Artificial Sequence
  synthetic [barcode part1]
tattgcgtggcgttag

SEQ ID NO: 42204 - DNA, 16 bp, Artificial Sequence
  synthetic [barcode part1]
atacctccagtagtct

SEQ ID NO: 42205 - DNA, 16 bp, Artificial Sequence
  synthetic [barcode part1]
agagtccggtactgtt

SEQ ID NO: 42206 - DNA, 16 bp, Artificial Sequence
  synthetic [barcode part1]
ccgtccagtaatatct

SEQ ID NO: 42207 - DNA, 16 bp, Artificial Sequence
  synthetic [barcode part1]
tgattcggcgaagacg

SEQ ID NO: 42208 - DNA, 16 bp, Artificial Sequence
  synthetic [barcode part1]
atctcttgtgtcaacg

SEQ ID NO: 42209 - DNA, 16 bp, Artificial Sequence
  synthetic [barcode part1]
gttagacacagagatc

SEQ ID NO: 42210 - DNA, 16 bp, Artificial Sequence
  synthetic [barcode part1]
tcgcggtaactaactg

SEQ ID NO: 42211 - DNA, 16 bp, Artificial Sequence
  synthetic [barcode part1]
gttattcgtgaacctc

SEQ ID NO: 42212 - DNA, 16 bp, Artificial Sequence
  synthetic [barcode part1]
aacacacacactgacc

SEQ ID NO: 42213 - DNA, 16 bp, Artificial Sequence
  synthetic [barcode part1]
tcaactgacacgtacg

SEQ ID NO: 42214 - DNA, 16 bp, Artificial Sequence
  synthetic [barcode part1]
attagtaggcaacgac

SEQ ID NO: 42215 - DNA, 16 bp, Artificial Sequence
  synthetic [barcode part1]
acggacaataacactg

SEQ ID NO: 42216 - DNA, 16 bp, Artificial Sequence
  synthetic [barcode part1]
acaactccggagacag

SEQ ID NO: 42217 - DNA, 16 bp, Artificial Sequence
  synthetic [barcode part1]
attgtctgcgataggc

SEQ ID NO: 42218 - DNA, 16 bp, Artificial Sequence
  synthetic [barcode part1]
tcaatccacctaggtt

SEQ ID NO: 42219 - DNA, 16 bp, Artificial Sequence
  synthetic [barcode part1]
attgttccgagtatcc

SEQ ID NO: 42220 - DNA, 16 bp, Artificial Sequence
  synthetic [barcode part1]
caccaataccgatacg

SEQ ID NO: 42221 - DNA, 16 bp, Artificial Sequence
  synthetic [barcode part1]
agacggattcgaggtc

SEQ ID NO: 42222 - DNA, 16 bp, Artificial Sequence
  synthetic [barcode part1]
tagtgaaccgccttag

SEQ ID NO: 42223 - DNA, 16 bp, Artificial Sequence
  synthetic [barcode part1]
agaggcgcaagtcact

SEQ ID NO: 42224 - DNA, 16 bp, Artificial Sequence
  synthetic [barcode part1]
acgcaatcacgtgatc

SEQ ID NO: 42225 - DNA, 16 bp, Artificial Sequence
  synthetic [barcode part1]
gtaagtcagtcgtacc

SEQ ID NO: 42226 - DNA, 16 bp, Artificial Sequence
  synthetic [barcode part1]
gtaatcggatcaagac

SEQ ID NO: 42227 - DNA, 16 bp, Artificial Sequence
  synthetic [barcode part1]
gtcaatcggtctcaag

SEQ ID NO: 42228 - DNA, 16 bp, Artificial Sequence
  synthetic [barcode part1]
acgatacctggtcaac

SEQ ID NO: 42229 - DNA, 16 bp, Artificial Sequence
  synthetic [barcode part1]
acttacgttcttggtg

SEQ ID NO: 42230 - DNA, 16 bp, Artificial Sequence
  synthetic [barcode part1]
gaggtacctagattag

SEQ ID NO: 42231 - DNA, 16 bp, Artificial Sequence
  synthetic [barcode part1]
agatctctcaagaccg

SEQ ID NO: 42232 - DNA, 16 bp, Artificial Sequence
  synthetic [barcode part1]
ccgcaactatagtacg

SEQ ID NO: 42233 - DNA, 16 bp, Artificial Sequence
  synthetic [barcode part1]
taggccggtacaagac

SEQ ID NO: 42234 - DNA, 16 bp, Artificial Sequence
  synthetic [barcode part1]
tcaacttcgtcctgtc

SEQ ID NO: 42235 - DNA, 16 bp, Artificial Sequence
  synthetic [barcode part1]
acgaacctcttcaact

SEQ ID NO: 42236 - DNA, 16 bp, Artificial Sequence
  synthetic [barcode part1]
gtgcagttgcaactgt

SEQ ID NO: 42237 - DNA, 16 bp, Artificial Sequence
  synthetic [barcode part1]
gaactcgtaggtctgt

SEQ ID NO: 42238 - DNA, 16 bp, Artificial Sequence
  synthetic [barcode part1]
tctccttaccgcaatc

SEQ ID NO: 42239 - DNA, 16 bp, Artificial Sequence
  synthetic [barcode part1]
actaggtgcggagatc

SEQ ID NO: 42240 - DNA, 16 bp, Artificial Sequence
  synthetic [barcode part1]
tgtcgtatcagaaccg

SEQ ID NO: 42241 - DNA, 16 bp, Artificial Sequence
  synthetic [barcode part1]
gtagtctgcgacttag

SEQ ID NO: 42242 - DNA, 16 bp, Artificial Sequence
  synthetic [barcode part1]
ccaattgaggatcctg

SEQ ID NO: 42243 - DNA, 16 bp, Artificial Sequence
  synthetic [barcode part1]
gtacagtgttgcgtac

SEQ ID NO: 42244 - DNA, 16 bp, Artificial Sequence
  synthetic [barcode part1]
tacgttcctcacacct

SEQ ID NO: 42245 - DNA, 16 bp, Artificial Sequence
  synthetic [barcode part1]
gcgccttgacctagtt

SEQ ID NO: 42246 - DNA, 16 bp, Artificial Sequence
  synthetic [barcode part1]
caccaccttacgtggt

SEQ ID NO: 42247 - DNA, 16 bp, Artificial Sequence
  synthetic [barcode part1]
actgtgtacactcgag

SEQ ID NO: 42248 - DNA, 16 bp, Artificial Sequence
  synthetic [barcode part1]
attggaacacgactag

SEQ ID NO: 42249 - DNA, 16 bp, Artificial Sequence
  synthetic [barcode part1]
tataggcggcaaggtc

SEQ ID NO: 42250 - DNA, 16 bp, Artificial Sequence
  synthetic [barcode part1]
gcggacttatatcgac

SEQ ID NO: 42251 - DNA, 16 bp, Artificial Sequence
  synthetic [barcode part1]
ataaccgaggactaac

SEQ ID NO: 42252 - DNA, 16 bp, Artificial Sequence
  synthetic [barcode part1]
tcctgacgatcacgtc

SEQ ID NO: 42253 - DNA, 16 bp, Artificial Sequence
  synthetic [barcode part1]
gtcggtggttctctac

SEQ ID NO: 42254 - DNA, 16 bp, Artificial Sequence
  synthetic [barcode part1]
actctcgtatcctcac

SEQ ID NO: 42255 - DNA, 16 bp, Artificial Sequence
  synthetic [barcode part1]
gcgacacgtgttatac

SEQ ID NO: 42256 - DNA, 16 bp, Artificial Sequence
  synthetic [barcode part1]
atactcgtgccgttcg

SEQ ID NO: 42257 - DNA, 16 bp, Artificial Sequence
  synthetic [barcode part1]
tctctggaggattgac

SEQ ID NO: 42258 - DNA, 16 bp, Artificial Sequence
  synthetic [barcode part1]
gtctctgaagtgtgac

SEQ ID NO: 42259 - DNA, 16 bp, Artificial Sequence
  synthetic [barcode part1]
ttacacgccttggtcg

SEQ ID NO: 42260 - DNA, 16 bp, Artificial Sequence
  synthetic [barcode part1]
agaactcactccagac

SEQ ID NO: 42261 - DNA, 16 bp, Artificial Sequence
  synthetic [barcode part1]
tgtattacctcgatcg

SEQ ID NO: 42262 - DNA, 16 bp, Artificial Sequence
  synthetic [barcode part1]
tgacgtaggttgtgtc

SEQ ID NO: 42263 - DNA, 16 bp, Artificial Sequence
  synthetic [barcode part1]
gagtggttgtgttaag

SEQ ID NO: 42264 - DNA, 16 bp, Artificial Sequence
  synthetic [barcode part1]
gaggcaaggtattcgc

SEQ ID NO: 42265 - DNA, 16 bp, Artificial Sequence
  synthetic [barcode part1]
tactcgtcttggagtt

SEQ ID NO: 42266 - DNA, 16 bp, Artificial Sequence
  synthetic [barcode part1]
cactagagtggaggtc

SEQ ID NO: 42267 - DNA, 16 bp, Artificial Sequence
  synthetic [barcode part1]
agtacaacgccaggtg

SEQ ID NO: 42268 - DNA, 16 bp, Artificial Sequence
  synthetic [barcode part1]
ttctcctgaccttgac

SEQ ID NO: 42269 - DNA, 16 bp, Artificial Sequence
  synthetic [barcode part1]
gtctgtcacggataac

SEQ ID NO: 42270 - DNA, 16 bp, Artificial Sequence
  synthetic [barcode part1]
taccgaggttcagtgt

SEQ ID NO: 42271 - DNA, 16 bp, Artificial Sequence
  synthetic [barcode part1]
ttggacagtcctgtcc

SEQ ID NO: 42272 - DNA, 16 bp, Artificial Sequence
  synthetic [barcode part1]
caacgtaacgtccaac

SEQ ID NO: 42273 - DNA, 16 bp, Artificial Sequence
  synthetic [barcode part1]
gaccgtacaactacgt

SEQ ID NO: 42274 - DNA, 16 bp, Artificial Sequence
  synthetic [barcode part1]
gtgcgtgactagttac

SEQ ID NO: 42275 - DNA, 16 bp, Artificial Sequence
  synthetic [barcode part1]
ttattgccggacgtcc

SEQ ID NO: 42276 - DNA, 16 bp, Artificial Sequence
  synthetic [barcode part1]
actacaacgccgtagt

SEQ ID NO: 42277 - DNA, 16 bp, Artificial Sequence
  synthetic [barcode part1]
gacgaggtgtgtcagt

SEQ ID NO: 42278 - DNA, 16 bp, Artificial Sequence
  synthetic [barcode part1]
ccggttcctcaatctt

SEQ ID NO: 42279 - DNA, 16 bp, Artificial Sequence
  synthetic [barcode part1]
gtgtctaggatctgtg

SEQ ID NO: 42280 - DNA, 16 bp, Artificial Sequence
  synthetic [barcode part1]
attctcgcaagtcact

SEQ ID NO: 42281 - DNA, 16 bp, Artificial Sequence
  synthetic [barcode part1]
gttcctacgccgagtt

SEQ ID NO: 42282 - DNA, 16 bp, Artificial Sequence
  synthetic [barcode part1]
cctcgttaagtgacag

SEQ ID NO: 42283 - DNA, 16 bp, Artificial Sequence
  synthetic [barcode part1]
tgttcgcaatatcgtc

SEQ ID NO: 42284 - DNA, 16 bp, Artificial Sequence
  synthetic [barcode part1]
gtgaatcaggataacc

SEQ ID NO: 42285 - DNA, 16 bp, Artificial Sequence
  synthetic [barcode part1]
cgtcttgaacacctgc

SEQ ID NO: 42286 - DNA, 16 bp, Artificial Sequence
  synthetic [barcode part1]
gtatcagatcggaggc

SEQ ID NO: 42287 - DNA, 16 bp, Artificial Sequence
  synthetic [barcode part1]
aactgtcactcggtag

SEQ ID NO: 42288 - DNA, 16 bp, Artificial Sequence
  synthetic [barcode part1]
agttgcacaacacacc

SEQ ID NO: 42289 - DNA, 16 bp, Artificial Sequence
  synthetic [barcode part1]
tgttaatcggcacgtg

SEQ ID NO: 42290 - DNA, 16 bp, Artificial Sequence
  synthetic [barcode part1]
acactgtctacttgtg

SEQ ID NO: 42291 - DNA, 16 bp, Artificial Sequence
  synthetic [barcode part1]
tccaccgaatctgcgt

SEQ ID NO: 42292 - DNA, 16 bp, Artificial Sequence
  synthetic [barcode part1]
gaacagaacagtgtct

SEQ ID NO: 42293 - DNA, 16 bp, Artificial Sequence
  synthetic [barcode part1]
gcaaccactgattctt

SEQ ID NO: 42294 - DNA, 16 bp, Artificial Sequence
  synthetic [barcode part1]
gacaatataggcactg

SEQ ID NO: 42295 - DNA, 16 bp, Artificial Sequence
  synthetic [barcode part1]
ccagaatcgttgtgac

SEQ ID NO: 42296 - DNA, 16 bp, Artificial Sequence
  synthetic [barcode part1]
ttgtctgcctatccgt

SEQ ID NO: 42297 - DNA, 16 bp, Artificial Sequence
  synthetic [barcode part1]
acactacgcgatactg

SEQ ID NO: 42298 - DNA, 16 bp, Artificial Sequence
  synthetic [barcode part1]
ttacgttccgccgaac

SEQ ID NO: 42299 - DNA, 16 bp, Artificial Sequence
  synthetic [barcode part1]
aataaggttgagtgcc

SEQ ID NO: 42300 - DNA, 16 bp, Artificial Sequence
  synthetic [barcode part1]
gatacgtatcgacacc

SEQ ID NO: 42301 - DNA, 16 bp, Artificial Sequence
  synthetic [barcode part1]
cgaccgtcttatagag

SEQ ID NO: 42302 - DNA, 16 bp, Artificial Sequence
  synthetic [barcode part1]
gacgttaaccgtagtc

SEQ ID NO: 42303 - DNA, 16 bp, Artificial Sequence
  synthetic [barcode part1]
ttcgaactggatccag

SEQ ID NO: 42304 - DNA, 16 bp, Artificial Sequence
  synthetic [barcode part1]
gacctggtcaagttac

SEQ ID NO: 42305 - DNA, 16 bp, Artificial Sequence
  synthetic [barcode part1]
ttaagaggccagagag

SEQ ID NO: 42306 - DNA, 16 bp, Artificial Sequence
  synthetic [barcode part1]
cagtactctcgcctag

SEQ ID NO: 42307 - DNA, 16 bp, Artificial Sequence
  synthetic [barcode part1]
atacagtagtcgaggt

SEQ ID NO: 42308 - DNA, 16 bp, Artificial Sequence
  synthetic [barcode part1]
agtctggtctcgtatt

SEQ ID NO: 42309 - DNA, 16 bp, Artificial Sequence
  synthetic [barcode part1]
acttccagacgtaggt

SEQ ID NO: 42310 - DNA, 16 bp, Artificial Sequence
  synthetic [barcode part1]
aacaacaactcacgag

SEQ ID NO: 42311 - DNA, 16 bp, Artificial Sequence
  synthetic [barcode part1]
agtctccgatccacac

SEQ ID NO: 42312 - DNA, 16 bp, Artificial Sequence
  synthetic [barcode part1]
gcgacaagtggttgtg

SEQ ID NO: 42313 - DNA, 16 bp, Artificial Sequence
  synthetic [barcode part1]
gttactgagaagtgtg

SEQ ID NO: 42314 - DNA, 16 bp, Artificial Sequence
  synthetic [barcode part1]
cgtcactgatatatcc

SEQ ID NO: 42315 - DNA, 16 bp, Artificial Sequence
  synthetic [barcode part1]
tgtcttgataggcctt

SEQ ID NO: 42316 - DNA, 16 bp, Artificial Sequence
  synthetic [barcode part1]
accaatcggtcgattg

SEQ ID NO: 42317 - DNA, 16 bp, Artificial Sequence
  synthetic [barcode part1]
tgtagtagttcgcctt

SEQ ID NO: 42318 - DNA, 16 bp, Artificial Sequence
  synthetic [barcode part1]
cgtacggtattccacc

SEQ ID NO: 42319 - DNA, 16 bp, Artificial Sequence
  synthetic [barcode part1]
cgtacaactgtacgac

SEQ ID NO: 42320 - DNA, 16 bp, Artificial Sequence
  synthetic [barcode part1]
aggtgagttgttcgtc

SEQ ID NO: 42321 - DNA, 16 bp, Artificial Sequence
  synthetic [barcode part1]
gagagattgtcggcgt

SEQ ID NO: 42322 - DNA, 16 bp, Artificial Sequence
  synthetic [barcode part1]
gttcgttacggcgtct

SEQ ID NO: 42323 - DNA, 16 bp, Artificial Sequence
  synthetic [barcode part1]
acctctccaattgtag

SEQ ID NO: 42324 - DNA, 16 bp, Artificial Sequence
  synthetic [barcode part1]
gagaggtgcaatcacc

SEQ ID NO: 42325 - DNA, 16 bp, Artificial Sequence
  synthetic [barcode part1]
aacgcacggaaccagt

SEQ ID NO: 42326 - DNA, 16 bp, Artificial Sequence
  synthetic [barcode part1]
gaggtggactcgtagt

SEQ ID NO: 42327 - DNA, 16 bp, Artificial Sequence
  synthetic [barcode part1]
atcgtagtccggaatc

SEQ ID NO: 42328 - DNA, 16 bp, Artificial Sequence
  synthetic [barcode part1]
tctcacgaccgagttc

SEQ ID NO: 42329 - DNA, 16 bp, Artificial Sequence
  synthetic [barcode part1]
agtgtctgttccttag

SEQ ID NO: 42330 - DNA, 16 bp, Artificial Sequence
  synthetic [barcode part1]
tccttggtgactgtgc

SEQ ID NO: 42331 - DNA, 16 bp, Artificial Sequence
  synthetic [barcode part1]
attcactactccagac

SEQ ID NO: 42332 - DNA, 16 bp, Artificial Sequence
  synthetic [barcode part1]
agttatagactcctcc

SEQ ID NO: 42333 - DNA, 16 bp, Artificial Sequence
  synthetic [barcode part1]
taaggtctcggaactc

SEQ ID NO: 42334 - DNA, 16 bp, Artificial Sequence
  synthetic [barcode part1]
ttacgtgcgtgactag

SEQ ID NO: 42335 - DNA, 16 bp, Artificial Sequence
  synthetic [barcode part1]
cgatatctatcgcgag

SEQ ID NO: 42336 - DNA, 16 bp, Artificial Sequence
  synthetic [barcode part1]
gccttactgccttatc

SEQ ID NO: 42337 - DNA, 16 bp, Artificial Sequence
  synthetic [barcode part1]
gccagtatagagagtt

SEQ ID NO: 42338 - DNA, 16 bp, Artificial Sequence
  synthetic [barcode part1]
tcttgcgagagtgtac

SEQ ID NO: 42339 - DNA, 16 bp, Artificial Sequence
  synthetic [barcode part1]
gacgactcaacctagt

SEQ ID NO: 42340 - DNA, 16 bp, Artificial Sequence
  synthetic [barcode part1]
tgttatcctgcacaac

SEQ ID NO: 42341 - DNA, 16 bp, Artificial Sequence
  synthetic [barcode part1]
gtgttgtgacaggcag

SEQ ID NO: 42342 - DNA, 16 bp, Artificial Sequence
  synthetic [barcode part1]
tagactacggtgacct

SEQ ID NO: 42343 - DNA, 16 bp, Artificial Sequence
  synthetic [barcode part1]
tgccgcagtattacag

SEQ ID NO: 42344 - DNA, 16 bp, Artificial Sequence
  synthetic [barcode part1]
ttcctgcgaaccactg

SEQ ID NO: 42345 - DNA, 16 bp, Artificial Sequence
  synthetic [barcode part1]
caggcacaactatacc

SEQ ID NO: 42346 - DNA, 16 bp, Artificial Sequence
  synthetic [barcode part1]
attgacagtgagacgt

SEQ ID NO: 42347 - DNA, 16 bp, Artificial Sequence
  synthetic [barcode part1]
gagtctaggattgaac

SEQ ID NO: 42348 - DNA, 16 bp, Artificial Sequence
  synthetic [barcode part1]
tccgatcgtgtcaacc

SEQ ID NO: 42349 - DNA, 16 bp, Artificial Sequence
  synthetic [barcode part1]
caacactcaggcgaag

SEQ ID NO: 42350 - DNA, 16 bp, Artificial Sequence
  synthetic [barcode part1]
ttcctggcgtggttac

SEQ ID NO: 42351 - DNA, 16 bp, Artificial Sequence
  synthetic [barcode part1]
gttacgaacgacgttc

SEQ ID NO: 42352 - DNA, 16 bp, Artificial Sequence
  synthetic [barcode part1]
tgatcttcggcgtgtc

SEQ ID NO: 42353 - DNA, 16 bp, Artificial Sequence
  synthetic [barcode part1]
gcggttcgtaagaacg

SEQ ID NO: 42354 - DNA, 16 bp, Artificial Sequence
  synthetic [barcode part1]
tctcctctcttctcct

SEQ ID NO: 42355 - DNA, 16 bp, Artificial Sequence
  synthetic [barcode part1]
gcacagaacttagtag

SEQ ID NO: 42356 - DNA, 16 bp, Artificial Sequence
  synthetic [barcode part1]
gagtactaggtctacc

SEQ ID NO: 42357 - DNA, 16 bp, Artificial Sequence
  synthetic [barcode part1]
tactccgcagacgttc

SEQ ID NO: 42358 - DNA, 16 bp, Artificial Sequence
  synthetic [barcode part1]
gtgcaacgtcaacgtt

SEQ ID NO: 42359 - DNA, 16 bp, Artificial Sequence
  synthetic [barcode part1]
tgactgtggtgataag

SEQ ID NO: 42360 - DNA, 16 bp, Artificial Sequence
  synthetic [barcode part1]
ttaattgccaggaccg

SEQ ID NO: 42361 - DNA, 16 bp, Artificial Sequence
  synthetic [barcode part1]
ttgacgtgttggtgtg

SEQ ID NO: 42362 - DNA, 16 bp, Artificial Sequence
  synthetic [barcode part1]
gtctcgtagtatactc

SEQ ID NO: 42363 - DNA, 16 bp, Artificial Sequence
  synthetic [barcode part1]
acgttggtgacgaggt

SEQ ID NO: 42364 - DNA, 16 bp, Artificial Sequence
  synthetic [barcode part1]
tcactccagaagtcag

SEQ ID NO: 42365 - DNA, 16 bp, Artificial Sequence
  synthetic [barcode part1]
ttgtcgatcttcgtag

SEQ ID NO: 42366 - DNA, 16 bp, Artificial Sequence
  synthetic [barcode part1]
agtggagagtctgcac

SEQ ID NO: 42367 - DNA, 16 bp, Artificial Sequence
  synthetic [barcode part1]
acgtggcaaggagttc

SEQ ID NO: 42368 - DNA, 16 bp, Artificial Sequence
  synthetic [barcode part1]
tcacaagaacggcgac

SEQ ID NO: 42369 - DNA, 16 bp, Artificial Sequence
  synthetic [barcode part1]
gaagaccaatcttccg

SEQ ID NO: 42370 - DNA, 16 bp, Artificial Sequence
  synthetic [barcode part1]
tgccttggaatccgtc

SEQ ID NO: 42371 - DNA, 16 bp, Artificial Sequence
  synthetic [barcode part1]
gttctcgtctagtggc

SEQ ID NO: 42372 - DNA, 16 bp, Artificial Sequence
  synthetic [barcode part1]
cagtgcctctatccag

SEQ ID NO: 42373 - DNA, 16 bp, Artificial Sequence
  synthetic [barcode part1]
ttgtgccgtgattcgc

SEQ ID NO: 42374 - DNA, 16 bp, Artificial Sequence
  synthetic [barcode part1]
accgtgatctaggact

SEQ ID NO: 42375 - DNA, 16 bp, Artificial Sequence
  synthetic [barcode part1]
aattggtcaacgccgt

SEQ ID NO: 42376 - DNA, 16 bp, Artificial Sequence
  synthetic [barcode part1]
ccgacgtcctcttaag

SEQ ID NO: 42377 - DNA, 16 bp, Artificial Sequence
  synthetic [barcode part1]
aaccaacacgtgtgtc

SEQ ID NO: 42378 - DNA, 16 bp, Artificial Sequence
  synthetic [barcode part1]
cggcaggtgaatatcg

SEQ ID NO: 42379 - DNA, 16 bp, Artificial Sequence
  synthetic [barcode part1]
gcgtcttaagagtacc

SEQ ID NO: 42380 - DNA, 16 bp, Artificial Sequence
  synthetic [barcode part1]
caatccagtctctgcg

SEQ ID NO: 42381 - DNA, 16 bp, Artificial Sequence
  synthetic [barcode part1]
atacagatcgcgtctg

SEQ ID NO: 42382 - DNA, 16 bp, Artificial Sequence
  synthetic [barcode part1]
cggcagtactgaattc

SEQ ID NO: 42383 - DNA, 16 bp, Artificial Sequence
  synthetic [barcode part1]
gttgacaagtgacggc

SEQ ID NO: 42384 - DNA, 16 bp, Artificial Sequence
  synthetic [barcode part1]
gaaggtctcctaactg

SEQ ID NO: 42385 - DNA, 16 bp, Artificial Sequence
  synthetic [barcode part1]
gacgatcgaggtacgt

SEQ ID NO: 42386 - DNA, 16 bp, Artificial Sequence
  synthetic [barcode part1]
cgtggattcgccttgt

SEQ ID NO: 42387 - DNA, 16 bp, Artificial Sequence
  synthetic [barcode part1]
caatacgatcgtcttc

SEQ ID NO: 42388 - DNA, 16 bp, Artificial Sequence
  synthetic [barcode part1]
ttctggcgagaactac

SEQ ID NO: 42389 - DNA, 16 bp, Artificial Sequence
  synthetic [barcode part1]
tacaacgattcgtctc

SEQ ID NO: 42390 - DNA, 16 bp, Artificial Sequence
  synthetic [barcode part1]
gacaacttctcgtgcc

SEQ ID NO: 42391 - DNA, 16 bp, Artificial Sequence
  synthetic [barcode part1]
gactcttgtgtgactt

SEQ ID NO: 42392 - DNA, 16 bp, Artificial Sequence
  synthetic [barcode part1]
cgatcttcgcgtgact

SEQ ID NO: 42393 - DNA, 16 bp, Artificial Sequence
  synthetic [barcode part1]
gcgtggttaatcacac

SEQ ID NO: 42394 - DNA, 16 bp, Artificial Sequence
  synthetic [barcode part1]
cgtagttcacgagttg

SEQ ID NO: 42395 - DNA, 16 bp, Artificial Sequence
  synthetic [barcode part1]
gccgtgtatattcgag

SEQ ID NO: 42396 - DNA, 16 bp, Artificial Sequence
  synthetic [barcode part1]
taagatctgtgcgcgt

SEQ ID NO: 42397 - DNA, 16 bp, Artificial Sequence
  synthetic [barcode part1]
accgatagtaaggcgc

SEQ ID NO: 42398 - DNA, 16 bp, Artificial Sequence
  synthetic [barcode part1]
gtctaagaagtagtgc

SEQ ID NO: 42399 - DNA, 16 bp, Artificial Sequence
  synthetic [barcode part1]
cacgtggttattactc

SEQ ID NO: 42400 - DNA, 16 bp, Artificial Sequence
  synthetic [barcode part1]
gtacgacaatcaaggt

SEQ ID NO: 42401 - DNA, 16 bp, Artificial Sequence
  synthetic [barcode part1]
tctctccggagttctt

SEQ ID NO: 42402 - DNA, 16 bp, Artificial Sequence
  synthetic [barcode part1]
agttggttggtgtcac

SEQ ID NO: 42403 - DNA, 16 bp, Artificial Sequence
  synthetic [barcode part1]
gagtatcgtagtgaac

SEQ ID NO: 42404 - DNA, 16 bp, Artificial Sequence
  synthetic [barcode part1]
tacggtgcaggcaagt

SEQ ID NO: 42405 - DNA, 16 bp, Artificial Sequence
  synthetic [barcode part1]
gtgatactgataccgc

SEQ ID NO: 42406 - DNA, 16 bp, Artificial Sequence
  synthetic [barcode part1]
gttcttgatccaacgt

SEQ ID NO: 42407 - DNA, 16 bp, Artificial Sequence
  synthetic [barcode part1]
gactactcaagaacag

SEQ ID NO: 42408 - DNA, 16 bp, Artificial Sequence
  synthetic [barcode part1]
caggttgacacttctt

SEQ ID NO: 42409 - DNA, 16 bp, Artificial Sequence
  synthetic [barcode part1]
cgttccttacagagag

SEQ ID NO: 42410 - DNA, 16 bp, Artificial Sequence
  synthetic [barcode part1]
cgttctccaatctaag

SEQ ID NO: 42411 - DNA, 16 bp, Artificial Sequence
  synthetic [barcode part1]
acgaggtgtagtagag

SEQ ID NO: 42412 - DNA, 16 bp, Artificial Sequence
  synthetic [barcode part1]
actgacactattgtcc

SEQ ID NO: 42413 - DNA, 16 bp, Artificial Sequence
  synthetic [barcode part1]
gttaacggtagtcgtc

SEQ ID NO: 42414 - DNA, 16 bp, Artificial Sequence
  synthetic [barcode part1]
gtaaccgagttaaggt

SEQ ID NO: 42415 - DNA, 16 bp, Artificial Sequence
  synthetic [barcode part1]
gcctgaaggtgagact

SEQ ID NO: 42416 - DNA, 16 bp, Artificial Sequence
  synthetic [barcode part1]
aacgactgaggtacgc

SEQ ID NO: 42417 - DNA, 16 bp, Artificial Sequence
  synthetic [barcode part1]
tacgcgacttgtaggt

SEQ ID NO: 42418 - DNA, 16 bp, Artificial Sequence
  synthetic [barcode part1]
tctggtagtccttgcg

SEQ ID NO: 42419 - DNA, 16 bp, Artificial Sequence
  synthetic [barcode part1]
tatccgatcaagtgcg

SEQ ID NO: 42420 - DNA, 16 bp, Artificial Sequence
  synthetic [barcode part1]
caggtaggcaagtaag

SEQ ID NO: 42421 - DNA, 16 bp, Artificial Sequence
  synthetic [barcode part1]
tctgacctgtacaatc

SEQ ID NO: 42422 - DNA, 16 bp, Artificial Sequence
  synthetic [barcode part1]
tacggacgtggtgagt

SEQ ID NO: 42423 - DNA, 16 bp, Artificial Sequence
  synthetic [barcode part1]
ccttgcgattgtcggt

SEQ ID NO: 42424 - DNA, 16 bp, Artificial Sequence
  synthetic [barcode part1]
atcctgactaggactg

SEQ ID NO: 42425 - DNA, 16 bp, Artificial Sequence
  synthetic [barcode part1]
gacctatcttatcgtg

SEQ ID NO: 42426 - DNA, 16 bp, Artificial Sequence
  synthetic [barcode part1]
tcgcgtctgccagatt

SEQ ID NO: 42427 - DNA, 16 bp, Artificial Sequence
  synthetic [barcode part1]
tcctccttgtacacgt

SEQ ID NO: 42428 - DNA, 16 bp, Artificial Sequence
  synthetic [barcode part1]
ttgttgttgccgtctc

SEQ ID NO: 42429 - DNA, 16 bp, Artificial Sequence
  synthetic [barcode part1]
ccactaccactcagac

SEQ ID NO: 42430 - DNA, 16 bp, Artificial Sequence
  synthetic [barcode part1]
ttggagtgtagacggc

SEQ ID NO: 42431 - DNA, 16 bp, Artificial Sequence
  synthetic [barcode part1]
tgacgcgtcttcaacc

SEQ ID NO: 42432 - DNA, 16 bp, Artificial Sequence
  synthetic [barcode part1]
atacgcgcagtcaact

SEQ ID NO: 42433 - DNA, 16 bp, Artificial Sequence
  synthetic [barcode part1]
cactcctaccgaactg

SEQ ID NO: 42434 - DNA, 16 bp, Artificial Sequence
  synthetic [barcode part1]
cacggtctgatctctg

SEQ ID NO: 42435 - DNA, 16 bp, Artificial Sequence
  synthetic [barcode part1]
taacgacgtattcctc

SEQ ID NO: 42436 - DNA, 16 bp, Artificial Sequence
  synthetic [barcode part1]
tcaagtaggacggcgt

SEQ ID NO: 42437 - DNA, 16 bp, Artificial Sequence
  synthetic [barcode part1]
cgattcctgtacggtc

SEQ ID NO: 42438 - DNA, 16 bp, Artificial Sequence
  synthetic [barcode part1]
gaggacttcttgatcg

SEQ ID NO: 42439 - DNA, 16 bp, Artificial Sequence
  synthetic [barcode part1]
aggtgttcaagtgtcc

SEQ ID NO: 42440 - DNA, 16 bp, Artificial Sequence
  synthetic [barcode part1]
gtctaacagagatacg

SEQ ID NO: 42441 - DNA, 16 bp, Artificial Sequence
  synthetic [barcode part1]
tgtataacgtcttgcc

SEQ ID NO: 42442 - DNA, 16 bp, Artificial Sequence
  synthetic [barcode part1]
tacacttgcctggtgc

SEQ ID NO: 42443 - DNA, 16 bp, Artificial Sequence
  synthetic [barcode part1]
tgtgttccttggtagt

SEQ ID NO: 42444 - DNA, 16 bp, Artificial Sequence
  synthetic [barcode part1]
cgaatactcctcgacc

SEQ ID NO: 42445 - DNA, 16 bp, Artificial Sequence
  synthetic [barcode part1]
caggacctgattagtc

SEQ ID NO: 42446 - DNA, 16 bp, Artificial Sequence
  synthetic [barcode part1]
agacaccacttgcagt

SEQ ID NO: 42447 - DNA, 16 bp, Artificial Sequence
  synthetic [barcode part1]
aaccggaggcaataag

SEQ ID NO: 42448 - DNA, 16 bp, Artificial Sequence
  synthetic [barcode part1]
tattaaggcgagagtc

SEQ ID NO: 42449 - DNA, 16 bp, Artificial Sequence
  synthetic [barcode part1]
aggcgattacgaattg

SEQ ID NO: 42450 - DNA, 16 bp, Artificial Sequence
  synthetic [barcode part1]
aattctaccacggcag

SEQ ID NO: 42451 - DNA, 16 bp, Artificial Sequence
  synthetic [barcode part1]
agtcgttcgagaatag

SEQ ID NO: 42452 - DNA, 16 bp, Artificial Sequence
  synthetic [barcode part1]
tcgagagaaggactag

SEQ ID NO: 42453 - DNA, 16 bp, Artificial Sequence
  synthetic [barcode part1]
cggtctcaacttcctt

SEQ ID NO: 42454 - DNA, 16 bp, Artificial Sequence
  synthetic [barcode part1]
tcctcaacgacgcgtt

SEQ ID NO: 42455 - DNA, 16 bp, Artificial Sequence
  synthetic [barcode part1]
taagttacacgccttc

SEQ ID NO: 42456 - DNA, 16 bp, Artificial Sequence
  synthetic [barcode part1]
atccagtcagtggttg

SEQ ID NO: 42457 - DNA, 16 bp, Artificial Sequence
  synthetic [barcode part1]
caggccagattactac

SEQ ID NO: 42458 - DNA, 16 bp, Artificial Sequence
  synthetic [barcode part1]
cacgagtacgaactct

SEQ ID NO: 42459 - DNA, 16 bp, Artificial Sequence
  synthetic [barcode part1]
aggaggtattcagatc

SEQ ID NO: 42460 - DNA, 16 bp, Artificial Sequence
  synthetic [barcode part1]
tctctcgattctccag

SEQ ID NO: 42461 - DNA, 16 bp, Artificial Sequence
  synthetic [barcode part1]
aggtgaggaaccttgc

SEQ ID NO: 42462 - DNA, 16 bp, Artificial Sequence
  synthetic [barcode part1]
tacgccgaaccaagag

SEQ ID NO: 42463 - DNA, 16 bp, Artificial Sequence
  synthetic [barcode part1]
caccgagtagaggtac

SEQ ID NO: 42464 - DNA, 16 bp, Artificial Sequence
  synthetic [barcode part1]
gcgttctgacttgacc

SEQ ID NO: 42465 - DNA, 16 bp, Artificial Sequence
  synthetic [barcode part1]
ataggatctgcaggcg

SEQ ID NO: 42466 - DNA, 16 bp, Artificial Sequence
  synthetic [barcode part1]
gtggcacgattaactc

SEQ ID NO: 42467 - DNA, 16 bp, Artificial Sequence
  synthetic [barcode part1]
tgtgataacggcgtct

SEQ ID NO: 42468 - DNA, 16 bp, Artificial Sequence
  synthetic [barcode part1]
gagtataatcgagtcg

SEQ ID NO: 42469 - DNA, 16 bp, Artificial Sequence
  synthetic [barcode part1]
aattgcgtagtcgcac

SEQ ID NO: 42470 - DNA, 16 bp, Artificial Sequence
  synthetic [barcode part1]
gcgcgattcttgactc

SEQ ID NO: 42471 - DNA, 16 bp, Artificial Sequence
  synthetic [barcode part1]
gcgcacttgtcttgtg

SEQ ID NO: 42472 - DNA, 16 bp, Artificial Sequence
  synthetic [barcode part1]
tggttccagttctctc

SEQ ID NO: 42473 - DNA, 16 bp, Artificial Sequence
  synthetic [barcode part1]
atattccgcacaggac

SEQ ID NO: 42474 - DNA, 16 bp, Artificial Sequence
  synthetic [barcode part1]
tcggaacgcaagtggt

SEQ ID NO: 42475 - DNA, 16 bp, Artificial Sequence
  synthetic [barcode part1]
tagactgttggtgacc

SEQ ID NO: 42476 - DNA, 16 bp, Artificial Sequence
  synthetic [barcode part1]
gacttacaggtctacg

SEQ ID NO: 42477 - DNA, 16 bp, Artificial Sequence
  synthetic [barcode part1]
attatagttcgcctgc

SEQ ID NO: 42478 - DNA, 16 bp, Artificial Sequence
  synthetic [barcode part1]
ttatcgtacggtaggc

SEQ ID NO: 42479 - DNA, 16 bp, Artificial Sequence
  synthetic [barcode part1]
agaggacactcagacc

SEQ ID NO: 42480 - DNA, 16 bp, Artificial Sequence
  synthetic [barcode part1]
ccgacttacttcttgc

SEQ ID NO: 42481 - DNA, 16 bp, Artificial Sequence
  synthetic [barcode part1]
ttccaagatctatccg

SEQ ID NO: 42482 - DNA, 16 bp, Artificial Sequence
  synthetic [barcode part1]
aacaatctgcgaaggt

SEQ ID NO: 42483 - DNA, 16 bp, Artificial Sequence
  synthetic [barcode part1]
cacttcggtcttactc

SEQ ID NO: 42484 - DNA, 16 bp, Artificial Sequence
  synthetic [barcode part1]
acgtgagatctgatag

SEQ ID NO: 42485 - DNA, 16 bp, Artificial Sequence
  synthetic [barcode part1]
acgaagactccacact

SEQ ID NO: 42486 - DNA, 16 bp, Artificial Sequence
  synthetic [barcode part1]
tgccggtagaggattg

SEQ ID NO: 42487 - DNA, 16 bp, Artificial Sequence
  synthetic [barcode part1]
cctaattcagttgcac

SEQ ID NO: 42488 - DNA, 16 bp, Artificial Sequence
  synthetic [barcode part1]
ccggaactctatctgc

SEQ ID NO: 42489 - DNA, 16 bp, Artificial Sequence
  synthetic [barcode part1]
ttgtgtgtggtacacg

SEQ ID NO: 42490 - DNA, 16 bp, Artificial Sequence
  synthetic [barcode part1]
gacacgcctcttcaac

SEQ ID NO: 42491 - DNA, 16 bp, Artificial Sequence
  synthetic [barcode part1]
cggttgaagttctggt

SEQ ID NO: 42492 - DNA, 16 bp, Artificial Sequence
  synthetic [barcode part1]
cacaagttcgtagacc

SEQ ID NO: 42493 - DNA, 16 bp, Artificial Sequence
  synthetic [barcode part1]
gttgttccggatatct

SEQ ID NO: 42494 - DNA, 16 bp, Artificial Sequence
  synthetic [barcode part1]
gagaatacttagtggc

SEQ ID NO: 42495 - DNA, 16 bp, Artificial Sequence
  synthetic [barcode part1]
gtggtacagtcctagt

SEQ ID NO: 42496 - DNA, 16 bp, Artificial Sequence
  synthetic [barcode part1]
caggattcgaccaatc

SEQ ID NO: 42497 - DNA, 16 bp, Artificial Sequence
  synthetic [barcode part1]
taacgcgtgtggatct

SEQ ID NO: 42498 - DNA, 16 bp, Artificial Sequence
  synthetic [barcode part1]
cctcacgatacaaggt

SEQ ID NO: 42499 - DNA, 16 bp, Artificial Sequence
  synthetic [barcode part1]
gatactgacaccgtac

SEQ ID NO: 42500 - DNA, 16 bp, Artificial Sequence
  synthetic [barcode part1]
aaccgcaaggatcggt

SEQ ID NO: 42501 - DNA, 16 bp, Artificial Sequence
  synthetic [barcode part1]
cgacaaccaacttggt

SEQ ID NO: 42502 - DNA, 16 bp, Artificial Sequence
  synthetic [barcode part1]
gttctatcaagtctgc

SEQ ID NO: 42503 - DNA, 16 bp, Artificial Sequence
  synthetic [barcode part1]
ttctgcactagtggtt

SEQ ID NO: 42504 - DNA, 16 bp, Artificial Sequence
  synthetic [barcode part1]
gcgtcggaggacaatt

SEQ ID NO: 42505 - DNA, 16 bp, Artificial Sequence
  synthetic [barcode part1]
tgcactccactagacc

SEQ ID NO: 42506 - DNA, 16 bp, Artificial Sequence
  synthetic [barcode part1]
tcgtgcggagactaag

SEQ ID NO: 42507 - DNA, 16 bp, Artificial Sequence
  synthetic [barcode part1]
taaggaacggtacgcc

SEQ ID NO: 42508 - DNA, 16 bp, Artificial Sequence
  synthetic [barcode part1]
atatccgattccgttg

SEQ ID NO: 42509 - DNA, 16 bp, Artificial Sequence
  synthetic [barcode part1]
gccagtggtgattatc

SEQ ID NO: 42510 - DNA, 16 bp, Artificial Sequence
  synthetic [barcode part1]
gaccaaccacaacgtt

SEQ ID NO: 42511 - DNA, 16 bp, Artificial Sequence
  synthetic [barcode part1]
ccgtagagttcctcgt

SEQ ID NO: 42512 - DNA, 16 bp, Artificial Sequence
  synthetic [barcode part1]
gacaaccttctgtgtt

SEQ ID NO: 42513 - DNA, 16 bp, Artificial Sequence
  synthetic [barcode part1]
atcttaccagaggacc

SEQ ID NO: 42514 - DNA, 16 bp, Artificial Sequence
  synthetic [barcode part1]
taaggcggaacgttcg

SEQ ID NO: 42515 - DNA, 16 bp, Artificial Sequence
  synthetic [barcode part1]
taacttaccgtgtctg

SEQ ID NO: 42516 - DNA, 16 bp, Artificial Sequence
  synthetic [barcode part1]
gtaaggacgacgacct

SEQ ID NO: 42517 - DNA, 16 bp, Artificial Sequence
  synthetic [barcode part1]
gatctccactgtcttc

SEQ ID NO: 42518 - DNA, 16 bp, Artificial Sequence
  synthetic [barcode part1]
ccggtagaataacctc

SEQ ID NO: 42519 - DNA, 16 bp, Artificial Sequence
  synthetic [barcode part1]
gaatagtcgcagaccg

SEQ ID NO: 42520 - DNA, 16 bp, Artificial Sequence
  synthetic [barcode part1]
ataggtaccacctacg

SEQ ID NO: 42521 - DNA, 16 bp, Artificial Sequence
  synthetic [barcode part1]
acctatccagagtctt

SEQ ID NO: 42522 - DNA, 16 bp, Artificial Sequence
  synthetic [barcode part1]
ttacacggaccggaag

SEQ ID NO: 42523 - DNA, 16 bp, Artificial Sequence
  synthetic [barcode part1]
tggatcaccagtaacc

SEQ ID NO: 42524 - DNA, 16 bp, Artificial Sequence
  synthetic [barcode part1]
agattgcaacacagac

SEQ ID NO: 42525 - DNA, 16 bp, Artificial Sequence
  synthetic [barcode part1]
tgcacgaggatcaggt

SEQ ID NO: 42526 - DNA, 16 bp, Artificial Sequence
  synthetic [barcode part1]
agaacctgcagtatcc

SEQ ID NO: 42527 - DNA, 16 bp, Artificial Sequence
  synthetic [barcode part1]
ttagtggtgtcgaacc

SEQ ID NO: 42528 - DNA, 16 bp, Artificial Sequence
  synthetic [barcode part1]
ccgttgttgttcggac

SEQ ID NO: 42529 - DNA, 16 bp, Artificial Sequence
  synthetic [barcode part1]
tccactgacacgactc

SEQ ID NO: 42530 - DNA, 16 bp, Artificial Sequence
  synthetic [barcode part1]
atccaactggttcgag

SEQ ID NO: 42531 - DNA, 16 bp, Artificial Sequence
  synthetic [barcode part1]
aacgaaggccacttct

SEQ ID NO: 42532 - DNA, 16 bp, Artificial Sequence
  synthetic [barcode part1]
gtctaggattctgtct

SEQ ID NO: 42533 - DNA, 16 bp, Artificial Sequence
  synthetic [barcode part1]
tggccaatcagtcagt

SEQ ID NO: 42534 - DNA, 16 bp, Artificial Sequence
  synthetic [barcode part1]
gactgtggtaccaact

SEQ ID NO: 42535 - DNA, 16 bp, Artificial Sequence
  synthetic [barcode part1]
cacggatcctgttatt

SEQ ID NO: 42536 - DNA, 16 bp, Artificial Sequence
  synthetic [barcode part1]
cgacttcagagaactc

SEQ ID NO: 42537 - DNA, 16 bp, Artificial Sequence
  synthetic [barcode part1]
tctgcgccaacagtct

SEQ ID NO: 42538 - DNA, 16 bp, Artificial Sequence
  synthetic [barcode part1]
agaatcacgcaggtcg

SEQ ID NO: 42539 - DNA, 16 bp, Artificial Sequence
  synthetic [barcode part1]
tgtgttgacacgtcag

SEQ ID NO: 42540 - DNA, 16 bp, Artificial Sequence
  synthetic [barcode part1]
aggtcttggttgatcg

SEQ ID NO: 42541 - DNA, 16 bp, Artificial Sequence
  synthetic [barcode part1]
gaatcgtatagaggtc

SEQ ID NO: 42542 - DNA, 16 bp, Artificial Sequence
  synthetic [barcode part1]
gtggaagactaagttc

SEQ ID NO: 42543 - DNA, 16 bp, Artificial Sequence
  synthetic [barcode part1]
ccaattggattggtcg

SEQ ID NO: 42544 - DNA, 16 bp, Artificial Sequence
  synthetic [barcode part1]
tattcggcacgagttg

SEQ ID NO: 42545 - DNA, 16 bp, Artificial Sequence
  synthetic [barcode part1]
cacaataccgtgacgt

SEQ ID NO: 42546 - DNA, 16 bp, Artificial Sequence
  synthetic [barcode part1]
ttacgccgtctaatac

SEQ ID NO: 42547 - DNA, 16 bp, Artificial Sequence
  synthetic [barcode part1]
cagatcagaccactac

SEQ ID NO: 42548 - DNA, 16 bp, Artificial Sequence
  synthetic [barcode part1]
tggacgtaagaactgt

SEQ ID NO: 42549 - DNA, 16 bp, Artificial Sequence
  synthetic [barcode part1]
actacttgagtggcac

SEQ ID NO: 42550 - DNA, 16 bp, Artificial Sequence
  synthetic [barcode part1]
gacactgtgtgacact

SEQ ID NO: 42551 - DNA, 16 bp, Artificial Sequence
  synthetic [barcode part1]
aactacgatcggtacc

SEQ ID NO: 42552 - DNA, 16 bp, Artificial Sequence
  synthetic [barcode part1]
gattgtggaggccaac

SEQ ID NO: 42553 - DNA, 16 bp, Artificial Sequence
  synthetic [barcode part1]
gtgtcagaagacgatt

SEQ ID NO: 42554 - DNA, 16 bp, Artificial Sequence
  synthetic [barcode part1]
ccggcgataagttgtt

SEQ ID NO: 42555 - DNA, 16 bp, Artificial Sequence
  synthetic [barcode part1]
gtaaggcctacgagtg

SEQ ID NO: 42556 - DNA, 16 bp, Artificial Sequence
  synthetic [barcode part1]
agtctcactcagagtg

SEQ ID NO: 42557 - DNA, 16 bp, Artificial Sequence
  synthetic [barcode part1]
cgttactgtgatcact

SEQ ID NO: 42558 - DNA, 16 bp, Artificial Sequence
  synthetic [barcode part1]
aggcactcttgaacgt

SEQ ID NO: 42559 - DNA, 16 bp, Artificial Sequence
  synthetic [barcode part1]
actcaactacgcctcg

SEQ ID NO: 42560 - DNA, 16 bp, Artificial Sequence
  synthetic [barcode part1]
taacggttctctgtac

SEQ ID NO: 42561 - DNA, 16 bp, Artificial Sequence
  synthetic [barcode part1]
cacttcctgtaccttg

SEQ ID NO: 42562 - DNA, 16 bp, Artificial Sequence
  synthetic [barcode part1]
tcagtccttgtgtaac

SEQ ID NO: 42563 - DNA, 16 bp, Artificial Sequence
  synthetic [barcode part1]
gttgttgtggtccaag

SEQ ID NO: 42564 - DNA, 16 bp, Artificial Sequence
  synthetic [barcode part1]
agaagacgacagtggt

SEQ ID NO: 42565 - DNA, 16 bp, Artificial Sequence
  synthetic [barcode part1]
gcagtgtcagtcaact

SEQ ID NO: 42566 - DNA, 16 bp, Artificial Sequence
  synthetic [barcode part1]
gccgtccttacagatc

SEQ ID NO: 42567 - DNA, 16 bp, Artificial Sequence
  synthetic [barcode part1]
gtacgatacgtgttgc

SEQ ID NO: 42568 - DNA, 16 bp, Artificial Sequence
  synthetic [barcode part1]
tatcacgtgattggcg

SEQ ID NO: 42569 - DNA, 16 bp, Artificial Sequence
  synthetic [barcode part1]
ccgtcttgtacaaccg

SEQ ID NO: 42570 - DNA, 16 bp, Artificial Sequence
  synthetic [barcode part1]
ccgagattcgtccgtt

SEQ ID NO: 42571 - DNA, 16 bp, Artificial Sequence
  synthetic [barcode part1]
agtggagaagaatcgc

SEQ ID NO: 42572 - DNA, 16 bp, Artificial Sequence
  synthetic [barcode part1]
atctgacgtacaagag

SEQ ID NO: 42573 - DNA, 16 bp, Artificial Sequence
  synthetic [barcode part1]
gtcagatcgcctctac

SEQ ID NO: 42574 - DNA, 16 bp, Artificial Sequence
  synthetic [barcode part1]
gactgatactacgacc

SEQ ID NO: 42575 - DNA, 16 bp, Artificial Sequence
  synthetic [barcode part1]
gtcaactccagttgag

SEQ ID NO: 42576 - DNA, 16 bp, Artificial Sequence
  synthetic [barcode part1]
cgtgaacacaggttct

SEQ ID NO: 42577 - DNA, 16 bp, Artificial Sequence
  synthetic [barcode part1]
gatcactgtggagacg

SEQ ID NO: 42578 - DNA, 16 bp, Artificial Sequence
  synthetic [barcode part1]
cacttcaagtgtctgt

SEQ ID NO: 42579 - DNA, 16 bp, Artificial Sequence
  synthetic [barcode part1]
ataaccgaaggttgac

SEQ ID NO: 42580 - DNA, 16 bp, Artificial Sequence
  synthetic [barcode part1]
cggatattcgatacgc

SEQ ID NO: 42581 - DNA, 16 bp, Artificial Sequence
  synthetic [barcode part1]
tgaactacgtgttcct

SEQ ID NO: 42582 - DNA, 16 bp, Artificial Sequence
  synthetic [barcode part1]
gtatcactagacagag

SEQ ID NO: 42583 - DNA, 16 bp, Artificial Sequence
  synthetic [barcode part1]
tgaccgcgataataag

SEQ ID NO: 42584 - DNA, 16 bp, Artificial Sequence
  synthetic [barcode part1]
gcggcgagaatattcg

SEQ ID NO: 42585 - DNA, 16 bp, Artificial Sequence
  synthetic [barcode part1]
gtctgatctctcgcag

SEQ ID NO: 42586 - DNA, 16 bp, Artificial Sequence
  synthetic [barcode part1]
agtggacgatatcgcg

SEQ ID NO: 42587 - DNA, 16 bp, Artificial Sequence
  synthetic [barcode part1]
atcgtcttcgtctcgt

SEQ ID NO: 42588 - DNA, 16 bp, Artificial Sequence
  synthetic [barcode part1]
gaccgtccgaagatag

SEQ ID NO: 42589 - DNA, 16 bp, Artificial Sequence
  synthetic [barcode part1]
aggattccgtccactc

SEQ ID NO: 42590 - DNA, 16 bp, Artificial Sequence
  synthetic [barcode part1]
gttatctgagttcacc

SEQ ID NO: 42591 - DNA, 16 bp, Artificial Sequence
  synthetic [barcode part1]
agtggttgactgttgc

SEQ ID NO: 42592 - DNA, 16 bp, Artificial Sequence
  synthetic [barcode part1]
gtcaataccactgtct

SEQ ID NO: 42593 - DNA, 16 bp, Artificial Sequence
  synthetic [barcode part1]
aggtggtaaccacgtg

SEQ ID NO: 42594 - DNA, 16 bp, Artificial Sequence
  synthetic [barcode part1]
aagtaccggcacttac

SEQ ID NO: 42595 - DNA, 16 bp, Artificial Sequence
  synthetic [barcode part1]
gttcaacgttggatcg

SEQ ID NO: 42596 - DNA, 16 bp, Artificial Sequence
  synthetic [barcode part1]
ttccaagtatcgcgag

SEQ ID NO: 42597 - DNA, 16 bp, Artificial Sequence
  synthetic [barcode part1]
tgtccaccagagttcc

SEQ ID NO: 42598 - DNA, 16 bp, Artificial Sequence
  synthetic [barcode part1]
cgtcgttcactagtgc

SEQ ID NO: 42599 - DNA, 16 bp, Artificial Sequence
  synthetic [barcode part1]
ataggcctcgagtact

SEQ ID NO: 42600 - DNA, 16 bp, Artificial Sequence
  synthetic [barcode part1]
ccgaatattgtggacc

SEQ ID NO: 42601 - DNA, 16 bp, Artificial Sequence
  synthetic [barcode part1]
cagaggttatcctcag

SEQ ID NO: 42602 - DNA, 16 bp, Artificial Sequence
  synthetic [barcode part1]
ttatcgcgcctgcagt

SEQ ID NO: 42603 - DNA, 16 bp, Artificial Sequence
  synthetic [barcode part1]
gattggcaactgacct

SEQ ID NO: 42604 - DNA, 16 bp, Artificial Sequence
  synthetic [barcode part1]
tgcgtgactcggttct

SEQ ID NO: 42605 - DNA, 16 bp, Artificial Sequence
  synthetic [barcode part1]
cagactagagatacac

SEQ ID NO: 42606 - DNA, 16 bp, Artificial Sequence
  synthetic [barcode part1]
tctagagtgtagtgcc

SEQ ID NO: 42607 - DNA, 16 bp, Artificial Sequence
  synthetic [barcode part1]
ccggatcggagtatag

SEQ ID NO: 42608 - DNA, 16 bp, Artificial Sequence
  synthetic [barcode part1]
acaacggtccacagag

SEQ ID NO: 42609 - DNA, 16 bp, Artificial Sequence
  synthetic [barcode part1]
agtatactggccacgt

SEQ ID NO: 42610 - DNA, 16 bp, Artificial Sequence
  synthetic [barcode part1]
aggtcgattctctgag

SEQ ID NO: 42611 - DNA, 16 bp, Artificial Sequence
  synthetic [barcode part1]
cacgttcacctaacgc

SEQ ID NO: 42612 - DNA, 16 bp, Artificial Sequence
  synthetic [barcode part1]
cgtcgaagtgaggact

SEQ ID NO: 42613 - DNA, 16 bp, Artificial Sequence
  synthetic [barcode part1]
ttctagtaaggaccgc

SEQ ID NO: 42614 - DNA, 16 bp, Artificial Sequence
  synthetic [barcode part1]
gagattccagagttcc

SEQ ID NO: 42615 - DNA, 16 bp, Artificial Sequence
  synthetic [barcode part1]
aacagtacggagtgag

SEQ ID NO: 42616 - DNA, 16 bp, Artificial Sequence
  synthetic [barcode part1]
gtactaggccgagaac

SEQ ID NO: 42617 - DNA, 16 bp, Artificial Sequence
  synthetic [barcode part1]
ccgactcgttcagact

SEQ ID NO: 42618 - DNA, 16 bp, Artificial Sequence
  synthetic [barcode part1]
ccaacagaggtcactt

SEQ ID NO: 42619 - DNA, 16 bp, Artificial Sequence
  synthetic [barcode part1]
aatcttagtccgtctg

SEQ ID NO: 42620 - DNA, 16 bp, Artificial Sequence
  synthetic [barcode part1]
cgcaattctgagtacg

SEQ ID NO: 42621 - DNA, 16 bp, Artificial Sequence
  synthetic [barcode part1]
tattgatccgatcctg

SEQ ID NO: 42622 - DNA, 16 bp, Artificial Sequence
  synthetic [barcode part1]
actcacttccactcgt

SEQ ID NO: 42623 - DNA, 16 bp, Artificial Sequence
  synthetic [barcode part1]
agaggcaacggttcac

SEQ ID NO: 42624 - DNA, 16 bp, Artificial Sequence
  synthetic [barcode part1]
accttgagtcgatcag

SEQ ID NO: 42625 - DNA, 16 bp, Artificial Sequence
  synthetic [barcode part1]
tgatattgcgacaccg

SEQ ID NO: 42626 - DNA, 16 bp, Artificial Sequence
  synthetic [barcode part1]
aactcttcctcaccac

SEQ ID NO: 42627 - DNA, 16 bp, Artificial Sequence
  synthetic [barcode part1]
cacaggactggtagtg

SEQ ID NO: 42628 - DNA, 16 bp, Artificial Sequence
  synthetic [barcode part1]
acactaggttggaggc

SEQ ID NO: 42629 - DNA, 16 bp, Artificial Sequence
  synthetic [barcode part1]
attctcttctcgaccg

SEQ ID NO: 42630 - DNA, 16 bp, Artificial Sequence
  synthetic [barcode part1]
caacgacgacctagtt

SEQ ID NO: 42631 - DNA, 16 bp, Artificial Sequence
  synthetic [barcode part1]
tctagttgtgcactac

SEQ ID NO: 42632 - DNA, 16 bp, Artificial Sequence
  synthetic [barcode part1]
gcctcaccactagtgt

SEQ ID NO: 42633 - DNA, 16 bp, Artificial Sequence
  synthetic [barcode part1]
tgccaccttcaatcct

SEQ ID NO: 42634 - DNA, 16 bp, Artificial Sequence
  synthetic [barcode part1]
aactggtacacacgtc

SEQ ID NO: 42635 - DNA, 16 bp, Artificial Sequence
  synthetic [barcode part1]
gactctccacgaatcc

SEQ ID NO: 42636 - DNA, 16 bp, Artificial Sequence
  synthetic [barcode part1]
tataatctgcgccgag

SEQ ID NO: 42637 - DNA, 16 bp, Artificial Sequence
  synthetic [barcode part1]
attgttcaggcctatc

SEQ ID NO: 42638 - DNA, 16 bp, Artificial Sequence
  synthetic [barcode part1]
tcctcctgttagtcgt

SEQ ID NO: 42639 - DNA, 16 bp, Artificial Sequence
  synthetic [barcode part1]
tgaatccaagtggtag

SEQ ID NO: 42640 - DNA, 16 bp, Artificial Sequence
  synthetic [barcode part1]
cacgcgttagtatcag

SEQ ID NO: 42641 - DNA, 16 bp, Artificial Sequence
  synthetic [barcode part1]
agtcagttggtaccac

SEQ ID NO: 42642 - DNA, 16 bp, Artificial Sequence
  synthetic [barcode part1]
tccaccaaccaagaac

SEQ ID NO: 42643 - DNA, 16 bp, Artificial Sequence
  synthetic [barcode part1]
tagtcgaggccaattc

SEQ ID NO: 42644 - DNA, 16 bp, Artificial Sequence
  synthetic [barcode part1]
accgagagattgagag

SEQ ID NO: 42645 - DNA, 16 bp, Artificial Sequence
  synthetic [barcode part1]
gccgtacacacttaag

SEQ ID NO: 42646 - DNA, 16 bp, Artificial Sequence
  synthetic [barcode part1]
cactaggtggactgtt

SEQ ID NO: 42647 - DNA, 16 bp, Artificial Sequence
  synthetic [barcode part1]
aggaataggatcgttc

SEQ ID NO: 42648 - DNA, 16 bp, Artificial Sequence
  synthetic [barcode part1]
tgtagtcctaggtgtg

SEQ ID NO: 42649 - DNA, 16 bp, Artificial Sequence
  synthetic [barcode part1]
gtggacttaatcctct

SEQ ID NO: 42650 - DNA, 16 bp, Artificial Sequence
  synthetic [barcode part1]
cggttgcaagtcgaag

SEQ ID NO: 42651 - DNA, 16 bp, Artificial Sequence
  synthetic [barcode part1]
gtgtcttccggcaact

SEQ ID NO: 42652 - DNA, 16 bp, Artificial Sequence
  synthetic [barcode part1]
ccacgttctactaggc

SEQ ID NO: 42653 - DNA, 16 bp, Artificial Sequence
  synthetic [barcode part1]
tgattggtgtgcacac

SEQ ID NO: 42654 - DNA, 16 bp, Artificial Sequence
  synthetic [barcode part1]
attctcggcggttcgt

SEQ ID NO: 42655 - DNA, 16 bp, Artificial Sequence
  synthetic [barcode part1]
gtccttgactcaacgc

SEQ ID NO: 42656 - DNA, 16 bp, Artificial Sequence
  synthetic [barcode part1]
ttggacgcacttaggt

SEQ ID NO: 42657 - DNA, 16 bp, Artificial Sequence
  synthetic [barcode part1]
gttatccacctgcggt

SEQ ID NO: 42658 - DNA, 16 bp, Artificial Sequence
  synthetic [barcode part1]
tcaagacaacgttgcc

SEQ ID NO: 42659 - DNA, 16 bp, Artificial Sequence
  synthetic [barcode part1]
accggaagtgcactag

SEQ ID NO: 42660 - DNA, 16 bp, Artificial Sequence
  synthetic [barcode part1]
acaactcgttctcgcg

SEQ ID NO: 42661 - DNA, 16 bp, Artificial Sequence
  synthetic [barcode part1]
acgcgataccagtact

SEQ ID NO: 42662 - DNA, 16 bp, Artificial Sequence
  synthetic [barcode part1]
cgccgaattacacctc

SEQ ID NO: 42663 - DNA, 16 bp, Artificial Sequence
  synthetic [barcode part1]
tactcaccgagtaggt

SEQ ID NO: 42664 - DNA, 16 bp, Artificial Sequence
  synthetic [barcode part1]
cgacgtaacgtctagt

SEQ ID NO: 42665 - DNA, 16 bp, Artificial Sequence
  synthetic [barcode part1]
gtcgccaatcaagttg

SEQ ID NO: 42666 - DNA, 16 bp, Artificial Sequence
  synthetic [barcode part1]
gttggcactgtcgtct

SEQ ID NO: 42667 - DNA, 16 bp, Artificial Sequence
  synthetic [barcode part1]
ccgcgaattgtacaac

SEQ ID NO: 42668 - DNA, 16 bp, Artificial Sequence
  synthetic [barcode part1]
gccacaagacgaacgt

SEQ ID NO: 42669 - DNA, 16 bp, Artificial Sequence
  synthetic [barcode part1]
gttgagtggtacggac

SEQ ID NO: 42670 - DNA, 16 bp, Artificial Sequence
  synthetic [barcode part1]
cacggtgtagataggc

SEQ ID NO: 42671 - DNA, 16 bp, Artificial Sequence
  synthetic [barcode part1]
ttacctaggacaggtc

SEQ ID NO: 42672 - DNA, 16 bp, Artificial Sequence
  synthetic [barcode part1]
tggttccgtgccaatc

SEQ ID NO: 42673 - DNA, 16 bp, Artificial Sequence
  synthetic [barcode part1]
gaagacggatacagac

SEQ ID NO: 42674 - DNA, 16 bp, Artificial Sequence
  synthetic [barcode part1]
tggcggtatcagattc

SEQ ID NO: 42675 - DNA, 16 bp, Artificial Sequence
  synthetic [barcode part1]
ttagacgagataacgc

SEQ ID NO: 42676 - DNA, 16 bp, Artificial Sequence
  synthetic [barcode part1]
accacgagagtgaatt

SEQ ID NO: 42677 - DNA, 16 bp, Artificial Sequence
  synthetic [barcode part1]
attgaatcgccgagtc

SEQ ID NO: 42678 - DNA, 16 bp, Artificial Sequence
  synthetic [barcode part1]
taacgacaggacgtgc

SEQ ID NO: 42679 - DNA, 16 bp, Artificial Sequence
  synthetic [barcode part1]
ttacggtaatcggtcg

SEQ ID NO: 42680 - DNA, 16 bp, Artificial Sequence
  synthetic [barcode part1]
ttcacgtcctctacgt

SEQ ID NO: 42681 - DNA, 16 bp, Artificial Sequence
  synthetic [barcode part1]
attgcggtaggcgagt

SEQ ID NO: 42682 - DNA, 16 bp, Artificial Sequence
  synthetic [barcode part1]
gacagacttactcacg

SEQ ID NO: 42683 - DNA, 16 bp, Artificial Sequence
  synthetic [barcode part1]
tagactgagaagtgtc

SEQ ID NO: 42684 - DNA, 16 bp, Artificial Sequence
  synthetic [barcode part1]
cagtgatccgatagtc

SEQ ID NO: 42685 - DNA, 16 bp, Artificial Sequence
  synthetic [barcode part1]
agtatagttgccagag

SEQ ID NO: 42686 - DNA, 16 bp, Artificial Sequence
  synthetic [barcode part1]
tgactggccagaatct

SEQ ID NO: 42687 - DNA, 16 bp, Artificial Sequence
  synthetic [barcode part1]
gtatcgttcacctgcg

SEQ ID NO: 42688 - DNA, 16 bp, Artificial Sequence
  synthetic [barcode part1]
atccgtaatcgtcttg

SEQ ID NO: 42689 - DNA, 16 bp, Artificial Sequence
  synthetic [barcode part1]
acggaaggattattgc

SEQ ID NO: 42690 - DNA, 16 bp, Artificial Sequence
  synthetic [barcode part1]
ttgaacaaggcggcgt

SEQ ID NO: 42691 - DNA, 16 bp, Artificial Sequence
  synthetic [barcode part1]
accgattagaggagag

SEQ ID NO: 42692 - DNA, 16 bp, Artificial Sequence
  synthetic [barcode part1]
caggtcactagatcgt

SEQ ID NO: 42693 - DNA, 16 bp, Artificial Sequence
  synthetic [barcode part1]
tagtagaatcctgccg

SEQ ID NO: 42694 - DNA, 16 bp, Artificial Sequence
  synthetic [barcode part1]
tgtgcgcgttgattag

SEQ ID NO: 42695 - DNA, 16 bp, Artificial Sequence
  synthetic [barcode part1]
gcaggaatcaagttac

SEQ ID NO: 42696 - DNA, 16 bp, Artificial Sequence
  synthetic [barcode part1]
agacactctcaccacc

SEQ ID NO: 42697 - DNA, 16 bp, Artificial Sequence
  synthetic [barcode part1]
tgcagtgcctgttcgt

SEQ ID NO: 42698 - DNA, 16 bp, Artificial Sequence
  synthetic [barcode part1]
cctaattcagtgtgtc

SEQ ID NO: 42699 - DNA, 16 bp, Artificial Sequence
  synthetic [barcode part1]
ttgtggagtccttcgc

SEQ ID NO: 42700 - DNA, 16 bp, Artificial Sequence
  synthetic [barcode part1]
gtgcaaccacacagtt

SEQ ID NO: 42701 - DNA, 16 bp, Artificial Sequence
  synthetic [barcode part1]
ttctactcctgagtag

SEQ ID NO: 42702 - DNA, 16 bp, Artificial Sequence
  synthetic [barcode part1]
actctccagaactgag

SEQ ID NO: 42703 - DNA, 16 bp, Artificial Sequence
  synthetic [barcode part1]
cacgcgtatcaatcag

SEQ ID NO: 42704 - DNA, 16 bp, Artificial Sequence
  synthetic [barcode part1]
atctgccttcacttgc

SEQ ID NO: 42705 - DNA, 16 bp, Artificial Sequence
  synthetic [barcode part1]
ccttcgataatcgcgc

SEQ ID NO: 42706 - DNA, 16 bp, Artificial Sequence
  synthetic [barcode part1]
ccaaggtcaagacctt

SEQ ID NO: 42707 - DNA, 16 bp, Artificial Sequence
  synthetic [barcode part1]
acgactacggttacac

SEQ ID NO: 42708 - DNA, 16 bp, Artificial Sequence
  synthetic [barcode part1]
acacgtacaaccgatc

SEQ ID NO: 42709 - DNA, 16 bp, Artificial Sequence
  synthetic [barcode part1]
tcggcctcgaacttgt

SEQ ID NO: 42710 - DNA, 16 bp, Artificial Sequence
  synthetic [barcode part1]
ccactactagatactc

SEQ ID NO: 42711 - DNA, 16 bp, Artificial Sequence
  synthetic [barcode part1]
gtaagtagatactgcg

SEQ ID NO: 42712 - DNA, 16 bp, Artificial Sequence
  synthetic [barcode part1]
ccttctggtggaatag

SEQ ID NO: 42713 - DNA, 16 bp, Artificial Sequence
  synthetic [barcode part1]
tctaggaccgactaac

SEQ ID NO: 42714 - DNA, 16 bp, Artificial Sequence
  synthetic [barcode part1]
gattgtcgtctccacg

SEQ ID NO: 42715 - DNA, 16 bp, Artificial Sequence
  synthetic [barcode part1]
tcctgacgatcgtacc

SEQ ID NO: 42716 - DNA, 16 bp, Artificial Sequence
  synthetic [barcode part1]
aattcggtagtggtcc

SEQ ID NO: 42717 - DNA, 16 bp, Artificial Sequence
  synthetic [barcode part1]
acagtacctagagtcc

SEQ ID NO: 42718 - DNA, 16 bp, Artificial Sequence
  synthetic [barcode part1]
gtacaactgaccgtac

SEQ ID NO: 42719 - DNA, 16 bp, Artificial Sequence
  synthetic [barcode part1]
tggaaggaggattgac

SEQ ID NO: 42720 - DNA, 16 bp, Artificial Sequence
  synthetic [barcode part1]
cgaaggttctataccg

SEQ ID NO: 42721 - DNA, 16 bp, Artificial Sequence
  synthetic [barcode part1]
ccaaccttcgtgtgac

SEQ ID NO: 42722 - DNA, 16 bp, Artificial Sequence
  synthetic [barcode part1]
gcgacctcgttcttag

SEQ ID NO: 42723 - DNA, 16 bp, Artificial Sequence
  synthetic [barcode part1]
ccgtccaacggtatct

SEQ ID NO: 42724 - DNA, 16 bp, Artificial Sequence
  synthetic [barcode part1]
tcactccagtctgcag

SEQ ID NO: 42725 - DNA, 16 bp, Artificial Sequence
  synthetic [barcode part1]
ttaggcgtgttacctt

SEQ ID NO: 42726 - DNA, 16 bp, Artificial Sequence
  synthetic [barcode part1]
taagtacgcgcagtct

SEQ ID NO: 42727 - DNA, 16 bp, Artificial Sequence
  synthetic [barcode part1]
gtatcacaggcgaacg

SEQ ID NO: 42728 - DNA, 16 bp, Artificial Sequence
  synthetic [barcode part1]
cgcagaattctgtgtg

SEQ ID NO: 42729 - DNA, 16 bp, Artificial Sequence
  synthetic [barcode part1]
tgcaccgtaactacag

SEQ ID NO: 42730 - DNA, 16 bp, Artificial Sequence
  synthetic [barcode part1]
cgttcaacgacttccg

SEQ ID NO: 42731 - DNA, 16 bp, Artificial Sequence
  synthetic [barcode part1]
cgccggattatatctt

SEQ ID NO: 42732 - DNA, 16 bp, Artificial Sequence
  synthetic [barcode part1]
cgtggtcgtataactg

SEQ ID NO: 42733 - DNA, 16 bp, Artificial Sequence
  synthetic [barcode part1]
tcgccttcgtggattg

SEQ ID NO: 42734 - DNA, 16 bp, Artificial Sequence
  synthetic [barcode part1]
ttgtatagtaccggcg

SEQ ID NO: 42735 - DNA, 16 bp, Artificial Sequence
  synthetic [barcode part1]
gtgcaacttaaggagt

SEQ ID NO: 42736 - DNA, 16 bp, Artificial Sequence
  synthetic [barcode part1]
caagtacacgtctgac

SEQ ID NO: 42737 - DNA, 16 bp, Artificial Sequence
  synthetic [barcode part1]
ccaatctctcggttct

SEQ ID NO: 42738 - DNA, 16 bp, Artificial Sequence
  synthetic [barcode part1]
acgcctgaggtagtag

SEQ ID NO: 42739 - DNA, 16 bp, Artificial Sequence
  synthetic [barcode part1]
gtagtgtcagtcgatc

SEQ ID NO: 42740 - DNA, 16 bp, Artificial Sequence
  synthetic [barcode part1]
cgttccgttacttcgt

SEQ ID NO: 42741 - DNA, 16 bp, Artificial Sequence
  synthetic [barcode part1]
gagtctgtccaattct

SEQ ID NO: 42742 - DNA, 16 bp, Artificial Sequence
  synthetic [barcode part1]
acagtaagacgcgtcg

SEQ ID NO: 42743 - DNA, 16 bp, Artificial Sequence
  synthetic [barcode part1]
cactaccaagtatctc

SEQ ID NO: 42744 - DNA, 16 bp, Artificial Sequence
  synthetic [barcode part1]
aaccagtcgtatacgc

SEQ ID NO: 42745 - DNA, 16 bp, Artificial Sequence
  synthetic [barcode part1]
cacgattcttctagtg

SEQ ID NO: 42746 - DNA, 16 bp, Artificial Sequence
  synthetic [barcode part1]
tctgcgtaactgttac

SEQ ID NO: 42747 - DNA, 16 bp, Artificial Sequence
  synthetic [barcode part1]
ccgaggtaatactacc

SEQ ID NO: 42748 - DNA, 16 bp, Artificial Sequence
  synthetic [barcode part1]
actgcagtctgagact

SEQ ID NO: 42749 - DNA, 16 bp, Artificial Sequence
  synthetic [barcode part1]
ttgccgcagtacctgt

SEQ ID NO: 42750 - DNA, 16 bp, Artificial Sequence
  synthetic [barcode part1]
tgtctgagaggtggtg

SEQ ID NO: 42751 - DNA, 16 bp, Artificial Sequence
  synthetic [barcode part1]
tgtgaacagacctgtc

SEQ ID NO: 42752 - DNA, 16 bp, Artificial Sequence
  synthetic [barcode part1]
cacgtaggcaaggtgt

SEQ ID NO: 42753 - DNA, 16 bp, Artificial Sequence
  synthetic [barcode part1]
ccgtctagacactacc

SEQ ID NO: 42754 - DNA, 16 bp, Artificial Sequence
  synthetic [barcode part1]
tcacctctcagacgtg

SEQ ID NO: 42755 - DNA, 16 bp, Artificial Sequence
  synthetic [barcode part1]
ttgtagacggactcgt

SEQ ID NO: 42756 - DNA, 16 bp, Artificial Sequence
  synthetic [barcode part1]
tgacgtatacgttggc

SEQ ID NO: 42757 - DNA, 16 bp, Artificial Sequence
  synthetic [barcode part1]
tcctgatacgcaatct

SEQ ID NO: 42758 - DNA, 16 bp, Artificial Sequence
  synthetic [barcode part1]
tacacgtcgcgtatag

SEQ ID NO: 42759 - DNA, 16 bp, Artificial Sequence
  synthetic [barcode part1]
cgttgtagtcgtaacg

SEQ ID NO: 42760 - DNA, 16 bp, Artificial Sequence
  synthetic [barcode part1]
ccggccgatattatag

SEQ ID NO: 42761 - DNA, 16 bp, Artificial Sequence
  synthetic [barcode part1]
cgtcaatccgaccttg

SEQ ID NO: 42762 - DNA, 16 bp, Artificial Sequence
  synthetic [barcode part1]
aattcctcttccggtc

SEQ ID NO: 42763 - DNA, 16 bp, Artificial Sequence
  synthetic [barcode part1]
tgtcgagacggagact

SEQ ID NO: 42764 - DNA, 16 bp, Artificial Sequence
  synthetic [barcode part1]
tataggacttcgtgcg

SEQ ID NO: 42765 - DNA, 16 bp, Artificial Sequence
  synthetic [barcode part1]
gtaatcctaaggacag

SEQ ID NO: 42766 - DNA, 16 bp, Artificial Sequence
  synthetic [barcode part1]
cgcctatataacgttc

SEQ ID NO: 42767 - DNA, 16 bp, Artificial Sequence
  synthetic [barcode part1]
gtctagagttctgttc

SEQ ID NO: 42768 - DNA, 16 bp, Artificial Sequence
  synthetic [barcode part1]
caccggtctctgattg

SEQ ID NO: 42769 - DNA, 16 bp, Artificial Sequence
  synthetic [barcode part1]
aaccacagtacactgc

SEQ ID NO: 42770 - DNA, 16 bp, Artificial Sequence
  synthetic [barcode part1]
gtcgaatctaccgaac

SEQ ID NO: 42771 - DNA, 16 bp, Artificial Sequence
  synthetic [barcode part1]
ttaggacaggcgagtc

SEQ ID NO: 42772 - DNA, 16 bp, Artificial Sequence
  synthetic [barcode part1]
ttatacaccttccgag

SEQ ID NO: 42773 - DNA, 16 bp, Artificial Sequence
  synthetic [barcode part1]
gaattccgagaggaag

SEQ ID NO: 42774 - DNA, 16 bp, Artificial Sequence
  synthetic [barcode part1]
gcacggtaactaggac

SEQ ID NO: 42775 - DNA, 16 bp, Artificial Sequence
  synthetic [barcode part1]
gtagacttgcaccaac

SEQ ID NO: 42776 - DNA, 16 bp, Artificial Sequence
  synthetic [barcode part1]
cagtgagttcaagtag

SEQ ID NO: 42777 - DNA, 16 bp, Artificial Sequence
  synthetic [barcode part1]
cggactattcctgcgt

SEQ ID NO: 42778 - DNA, 16 bp, Artificial Sequence
  synthetic [barcode part1]
ttgtggtgtcacagtg

SEQ ID NO: 42779 - DNA, 16 bp, Artificial Sequence
  synthetic [barcode part1]
tcggaagactacttcg

SEQ ID NO: 42780 - DNA, 16 bp, Artificial Sequence
  synthetic [barcode part1]
aaggcagtagagtgac

SEQ ID NO: 42781 - DNA, 16 bp, Artificial Sequence
  synthetic [barcode part1]
tcgtcggactagattg

SEQ ID NO: 42782 - DNA, 16 bp, Artificial Sequence
  synthetic [barcode part1]
aaggcggccgtaagtt

SEQ ID NO: 42783 - DNA, 16 bp, Artificial Sequence
  synthetic [barcode part1]
attgcacggaataacg

SEQ ID NO: 42784 - DNA, 16 bp, Artificial Sequence
  synthetic [barcode part1]
gacactaatacgtgcc

SEQ ID NO: 42785 - DNA, 16 bp, Artificial Sequence
  synthetic [barcode part1]
ttgactggtgtacacg

SEQ ID NO: 42786 - DNA, 16 bp, Artificial Sequence
  synthetic [barcode part1]
tgtgcggtctaactcc

SEQ ID NO: 42787 - DNA, 16 bp, Artificial Sequence
  synthetic [barcode part1]
acttcagaagacctcg

SEQ ID NO: 42788 - DNA, 16 bp, Artificial Sequence
  synthetic [barcode part1]
tgccacttaccaatac

SEQ ID NO: 42789 - DNA, 16 bp, Artificial Sequence
  synthetic [barcode part1]
gtaggcctgactcttc

SEQ ID NO: 42790 - DNA, 16 bp, Artificial Sequence
  synthetic [barcode part1]
tcgcggaatagagtgc

SEQ ID NO: 42791 - DNA, 16 bp, Artificial Sequence
  synthetic [barcode part1]
ttcttgacgtggccac

SEQ ID NO: 42792 - DNA, 16 bp, Artificial Sequence
  synthetic [barcode part1]
cgacctgatcttcacg

SEQ ID NO: 42793 - DNA, 16 bp, Artificial Sequence
  synthetic [barcode part1]
tgagtcgtagtgacct

SEQ ID NO: 42794 - DNA, 16 bp, Artificial Sequence
  synthetic [barcode part1]
ttcacacggttgttgt

SEQ ID NO: 42795 - DNA, 16 bp, Artificial Sequence
  synthetic [barcode part1]
cggcacggttattcct

SEQ ID NO: 42796 - DNA, 16 bp, Artificial Sequence
  synthetic [barcode part1]
aactcgaggagatatc

SEQ ID NO: 42797 - DNA, 16 bp, Artificial Sequence
  synthetic [barcode part1]
agttagacactccacg

SEQ ID NO: 42798 - DNA, 16 bp, Artificial Sequence
  synthetic [barcode part1]
gcgaattggagaccac

SEQ ID NO: 42799 - DNA, 16 bp, Artificial Sequence
  synthetic [barcode part1]
agtctcaggcagacag

SEQ ID NO: 42800 - DNA, 16 bp, Artificial Sequence
  synthetic [barcode part1]
tcgagatagatctcgc

SEQ ID NO: 42801 - DNA, 16 bp, Artificial Sequence
  synthetic [barcode part1]
acctcgttccaatctc

SEQ ID NO: 42802 - DNA, 16 bp, Artificial Sequence
  synthetic [barcode part1]
aggtacctcgtaggtt

SEQ ID NO: 42803 - DNA, 16 bp, Artificial Sequence
  synthetic [barcode part1]
gataactggtccggtt

SEQ ID NO: 42804 - DNA, 16 bp, Artificial Sequence
  synthetic [barcode part1]
cacgttctaagttacc

SEQ ID NO: 42805 - DNA, 16 bp, Artificial Sequence
  synthetic [barcode part1]
tgtcacaccaatcgag

SEQ ID NO: 42806 - DNA, 16 bp, Artificial Sequence
  synthetic [barcode part1]
tcgtctcggaatagtg

SEQ ID NO: 42807 - DNA, 16 bp, Artificial Sequence
  synthetic [barcode part1]
tatcacgagagtcctg

SEQ ID NO: 42808 - DNA, 16 bp, Artificial Sequence
  synthetic [barcode part1]
gtcaatcctctctctg

SEQ ID NO: 42809 - DNA, 16 bp, Artificial Sequence
  synthetic [barcode part1]
tggcgcgcaacttctt

SEQ ID NO: 42810 - DNA, 16 bp, Artificial Sequence
  synthetic [barcode part1]
aggtattacggtgagt

SEQ ID NO: 42811 - DNA, 16 bp, Artificial Sequence
  synthetic [barcode part1]
aggcaagattctagac

SEQ ID NO: 42812 - DNA, 16 bp, Artificial Sequence
  synthetic [barcode part1]
gacaactctggactac

SEQ ID NO: 42813 - DNA, 16 bp, Artificial Sequence
  synthetic [barcode part1]
gaggtccgaacgaatc

SEQ ID NO: 42814 - DNA, 16 bp, Artificial Sequence
  synthetic [barcode part1]
tgaagttcgtgtgcgt

SEQ ID NO: 42815 - DNA, 16 bp, Artificial Sequence
  synthetic [barcode part1]
atcgtagacttactcc

SEQ ID NO: 42816 - DNA, 16 bp, Artificial Sequence
  synthetic [barcode part1]
cgtacctctcaacgac

SEQ ID NO: 42817 - DNA, 16 bp, Artificial Sequence
  synthetic [barcode part1]
acgattcacagaggcg

SEQ ID NO: 42818 - DNA, 16 bp, Artificial Sequence
  synthetic [barcode part1]
ttccgatcacaagtct

SEQ ID NO: 42819 - DNA, 16 bp, Artificial Sequence
  synthetic [barcode part1]
agtctaggatctgacc

SEQ ID NO: 42820 - DNA, 16 bp, Artificial Sequence
  synthetic [barcode part1]
agaactacgacgagag

SEQ ID NO: 42821 - DNA, 16 bp, Artificial Sequence
  synthetic [barcode part1]
cgcgaaccaagtattc

SEQ ID NO: 42822 - DNA, 16 bp, Artificial Sequence
  synthetic [barcode part1]
tcacaggtcgtacagt

SEQ ID NO: 42823 - DNA, 16 bp, Artificial Sequence
  synthetic [barcode part1]
gagttactaggtcacc

SEQ ID NO: 42824 - DNA, 16 bp, Artificial Sequence
  synthetic [barcode part1]
cacttgagttagagag

SEQ ID NO: 42825 - DNA, 16 bp, Artificial Sequence
  synthetic [barcode part1]
ttccgaacttaggacg

SEQ ID NO: 42826 - DNA, 16 bp, Artificial Sequence
  synthetic [barcode part1]
attcctacgttcctgc

SEQ ID NO: 42827 - DNA, 16 bp, Artificial Sequence
  synthetic [barcode part1]
aaggccacaataggag

SEQ ID NO: 42828 - DNA, 16 bp, Artificial Sequence
  synthetic [barcode part1]
tatcctaaggcctatc

SEQ ID NO: 42829 - DNA, 16 bp, Artificial Sequence
  synthetic [barcode part1]
ccttctgcggattcag

SEQ ID NO: 42830 - DNA, 16 bp, Artificial Sequence
  synthetic [barcode part1]
ttacggaacctcttac

SEQ ID NO: 42831 - DNA, 16 bp, Artificial Sequence
  synthetic [barcode part1]
tgagtgtgaggtggtc

SEQ ID NO: 42832 - DNA, 16 bp, Artificial Sequence
  synthetic [barcode part1]
caagactctgaggttc

SEQ ID NO: 42833 - DNA, 16 bp, Artificial Sequence
  synthetic [barcode part1]
tacgtacaccagtcag

SEQ ID NO: 42834 - DNA, 16 bp, Artificial Sequence
  synthetic [barcode part1]
tcgtgttctcggtggt

SEQ ID NO: 42835 - DNA, 16 bp, Artificial Sequence
  synthetic [barcode part1]
aacagatagtaccgtg

SEQ ID NO: 42836 - DNA, 16 bp, Artificial Sequence
  synthetic [barcode part1]
agaccgtaacgtaagt

SEQ ID NO: 42837 - DNA, 16 bp, Artificial Sequence
  synthetic [barcode part1]
atagagacacgaaggc

SEQ ID NO: 42838 - DNA, 16 bp, Artificial Sequence
  synthetic [barcode part1]
cctgatagacgtggag

SEQ ID NO: 42839 - DNA, 16 bp, Artificial Sequence
  synthetic [barcode part1]
cggcactgtctattcg

SEQ ID NO: 42840 - DNA, 16 bp, Artificial Sequence
  synthetic [barcode part1]
cgacacggagataacc

SEQ ID NO: 42841 - DNA, 16 bp, Artificial Sequence
  synthetic [barcode part1]
gtagtcgccagaaggt

SEQ ID NO: 42842 - DNA, 16 bp, Artificial Sequence
  synthetic [barcode part1]
gcgtggtacgttaatc

SEQ ID NO: 42843 - DNA, 16 bp, Artificial Sequence
  synthetic [barcode part1]
gaagtcgttgaacgcg

SEQ ID NO: 42844 - DNA, 16 bp, Artificial Sequence
  synthetic [barcode part1]
cctgattgtgcgtcgt

SEQ ID NO: 42845 - DNA, 16 bp, Artificial Sequence
  synthetic [barcode part1]
ttcgacaggtagtctg

SEQ ID NO: 42846 - DNA, 16 bp, Artificial Sequence
  synthetic [barcode part1]
tggacgatatccgttg

SEQ ID NO: 42847 - DNA, 16 bp, Artificial Sequence
  synthetic [barcode part1]
actcgttcggaatctt

SEQ ID NO: 42848 - DNA, 16 bp, Artificial Sequence
  synthetic [barcode part1]
atacgtcgtaggatag

SEQ ID NO: 42849 - DNA, 16 bp, Artificial Sequence
  synthetic [barcode part1]
acaaccgaaggtcggt

SEQ ID NO: 42850 - DNA, 16 bp, Artificial Sequence
  synthetic [barcode part1]
ccgcacaattaacacg

SEQ ID NO: 42851 - DNA, 16 bp, Artificial Sequence
  synthetic [barcode part1]
ccaggtctctctgtag

SEQ ID NO: 42852 - DNA, 16 bp, Artificial Sequence
  synthetic [barcode part1]
cgcgttctgaaccgtt

SEQ ID NO: 42853 - DNA, 16 bp, Artificial Sequence
  synthetic [barcode part1]
gacctcttaacaggac

SEQ ID NO: 42854 - DNA, 16 bp, Artificial Sequence
  synthetic [barcode part1]
aatcgcgcaacacgtt

SEQ ID NO: 42855 - DNA, 16 bp, Artificial Sequence
  synthetic [barcode part1]
aggtgttgagttcacc

SEQ ID NO: 42856 - DNA, 16 bp, Artificial Sequence
  synthetic [barcode part1]
cgtcgtctgttggtgt

SEQ ID NO: 42857 - DNA, 16 bp, Artificial Sequence
  synthetic [barcode part1]
cactggcaaggtcaag

SEQ ID NO: 42858 - DNA, 16 bp, Artificial Sequence
  synthetic [barcode part1]
atcacttctcggacgc

SEQ ID NO: 42859 - DNA, 16 bp, Artificial Sequence
  synthetic [barcode part1]
tggacacaagagttgt

SEQ ID NO: 42860 - DNA, 16 bp, Artificial Sequence
  synthetic [barcode part1]
tggaaggactaatacc

SEQ ID NO: 42861 - DNA, 16 bp, Artificial Sequence
  synthetic [barcode part1]
ttgtgcctacttccac

SEQ ID NO: 42862 - DNA, 16 bp, Artificial Sequence
  synthetic [barcode part1]
tgttgcaccaactgag

SEQ ID NO: 42863 - DNA, 16 bp, Artificial Sequence
  synthetic [barcode part1]
accaaggaaggttgag

SEQ ID NO: 42864 - DNA, 16 bp, Artificial Sequence
  synthetic [barcode part1]
tcggataactctgttc

SEQ ID NO: 42865 - DNA, 16 bp, Artificial Sequence
  synthetic [barcode part1]
ttgcgagacctcctgt

SEQ ID NO: 42866 - DNA, 16 bp, Artificial Sequence
  synthetic [barcode part1]
taatacggttggaggt

SEQ ID NO: 42867 - DNA, 16 bp, Artificial Sequence
  synthetic [barcode part1]
tcaggcctgacttaag

SEQ ID NO: 42868 - DNA, 16 bp, Artificial Sequence
  synthetic [barcode part1]
attcggagtggcgaac

SEQ ID NO: 42869 - DNA, 16 bp, Artificial Sequence
  synthetic [barcode part1]
gtaggagaaccaccac

SEQ ID NO: 42870 - DNA, 16 bp, Artificial Sequence
  synthetic [barcode part1]
ccgattcttgtcactc

SEQ ID NO: 42871 - DNA, 16 bp, Artificial Sequence
  synthetic [barcode part1]
cactaccagtagtgac

SEQ ID NO: 42872 - DNA, 16 bp, Artificial Sequence
  synthetic [barcode part1]
agtaagaggagatcgc

SEQ ID NO: 42873 - DNA, 16 bp, Artificial Sequence
  synthetic [barcode part1]
tgttcttcctccacag

SEQ ID NO: 42874 - DNA, 16 bp, Artificial Sequence
  synthetic [barcode part1]
gtgttggacacaacct

SEQ ID NO: 42875 - DNA, 16 bp, Artificial Sequence
  synthetic [barcode part1]
acttgactggtaaccg

SEQ ID NO: 42876 - DNA, 16 bp, Artificial Sequence
  synthetic [barcode part1]
ttaccaggtgcctctg

SEQ ID NO: 42877 - DNA, 16 bp, Artificial Sequence
  synthetic [barcode part1]
ttcagtgacttctacg

SEQ ID NO: 42878 - DNA, 16 bp, Artificial Sequence
  synthetic [barcode part1]
gatcactgatacagag

SEQ ID NO: 42879 - DNA, 16 bp, Artificial Sequence
  synthetic [barcode part1]
ttacacggcactaacg

SEQ ID NO: 42880 - DNA, 16 bp, Artificial Sequence
  synthetic [barcode part1]
cgtaagtaggcctatc

SEQ ID NO: 42881 - DNA, 16 bp, Artificial Sequence
  synthetic [barcode part1]
gtcggtagaacactct

SEQ ID NO: 42882 - DNA, 16 bp, Artificial Sequence
  synthetic [barcode part1]
taacttatccgcgccg

SEQ ID NO: 42883 - DNA, 16 bp, Artificial Sequence
  synthetic [barcode part1]
tcgaacgaggttcgtt

SEQ ID NO: 42884 - DNA, 16 bp, Artificial Sequence
  synthetic [barcode part1]
tgacgagtaccacttg

SEQ ID NO: 42885 - DNA, 16 bp, Artificial Sequence
  synthetic [barcode part1]
taagattcggtcggtc

SEQ ID NO: 42886 - DNA, 16 bp, Artificial Sequence
  synthetic [barcode part1]
tatcggatagagacac

SEQ ID NO: 42887 - DNA, 16 bp, Artificial Sequence
  synthetic [barcode part1]
acttacggtgtccaag

SEQ ID NO: 42888 - DNA, 16 bp, Artificial Sequence
  synthetic [barcode part1]
tccgtggaagtgacag

SEQ ID NO: 42889 - DNA, 16 bp, Artificial Sequence
  synthetic [barcode part1]
caggtacgtgtgactt

SEQ ID NO: 42890 - DNA, 16 bp, Artificial Sequence
  synthetic [barcode part1]
gagagaactgaagtcg

SEQ ID NO: 42891 - DNA, 16 bp, Artificial Sequence
  synthetic [barcode part1]
tacgacaacttgttcc

SEQ ID NO: 42892 - DNA, 16 bp, Artificial Sequence
  synthetic [barcode part1]
cgtctactaagatctc

SEQ ID NO: 42893 - DNA, 16 bp, Artificial Sequence
  synthetic [barcode part1]
aaggcaatatccgagt

SEQ ID NO: 42894 - DNA, 16 bp, Artificial Sequence
  synthetic [barcode part1]
aagaacgtcgccaggt

SEQ ID NO: 42895 - DNA, 16 bp, Artificial Sequence
  synthetic [barcode part1]
ttgcgttagtagtcct

SEQ ID NO: 42896 - DNA, 16 bp, Artificial Sequence
  synthetic [barcode part1]
actgcaaggataagtc

SEQ ID NO: 42897 - DNA, 16 bp, Artificial Sequence
  synthetic [barcode part1]
tgtggtaatctcaggc

SEQ ID NO: 42898 - DNA, 16 bp, Artificial Sequence
  synthetic [barcode part1]
taaccggaaccaacct

SEQ ID NO: 42899 - DNA, 16 bp, Artificial Sequence
  synthetic [barcode part1]
gttgcctcgaacgttc

SEQ ID NO: 42900 - DNA, 16 bp, Artificial Sequence
  synthetic [barcode part1]
gttgtgtactgcctcg

SEQ ID NO: 42901 - DNA, 16 bp, Artificial Sequence
  synthetic [barcode part1]
cagttgaccaggattc

SEQ ID NO: 42902 - DNA, 16 bp, Artificial Sequence
  synthetic [barcode part1]
agactcagttcaggtc

SEQ ID NO: 42903 - DNA, 16 bp, Artificial Sequence
  synthetic [barcode part1]
tctgtccacttactcg

SEQ ID NO: 42904 - DNA, 16 bp, Artificial Sequence
  synthetic [barcode part1]
tggtcgcacgagatag

SEQ ID NO: 42905 - DNA, 16 bp, Artificial Sequence
  synthetic [barcode part1]
tgactagacactacgc

SEQ ID NO: 42906 - DNA, 16 bp, Artificial Sequence
  synthetic [barcode part1]
gtggaacggtacctag

SEQ ID NO: 42907 - DNA, 16 bp, Artificial Sequence
  synthetic [barcode part1]
gacgagtatctatccg

SEQ ID NO: 42908 - DNA, 16 bp, Artificial Sequence
  synthetic [barcode part1]
gtatcttctagaccac

SEQ ID NO: 42909 - DNA, 16 bp, Artificial Sequence
  synthetic [barcode part1]
tacagtgtgccacaac

SEQ ID NO: 42910 - DNA, 16 bp, Artificial Sequence
  synthetic [barcode part1]
ccggatcaagatatag

SEQ ID NO: 42911 - DNA, 16 bp, Artificial Sequence
  synthetic [barcode part1]
actcgtattcttggtg

SEQ ID NO: 42912 - DNA, 16 bp, Artificial Sequence
  synthetic [barcode part1]
tggtgcggaagactac

SEQ ID NO: 42913 - DNA, 16 bp, Artificial Sequence
  synthetic [barcode part1]
ttggtcctggacctac

SEQ ID NO: 42914 - DNA, 16 bp, Artificial Sequence
  synthetic [barcode part1]
tcggaatagtatcgcc

SEQ ID NO: 42915 - DNA, 16 bp, Artificial Sequence
  synthetic [barcode part1]
tatcttgcaggcgtcc

SEQ ID NO: 42916 - DNA, 16 bp, Artificial Sequence
  synthetic [barcode part1]
gattaacgcgtcacgt

SEQ ID NO: 42917 - DNA, 16 bp, Artificial Sequence
  synthetic [barcode part1]
gtaatccggcacagag

SEQ ID NO: 42918 - DNA, 16 bp, Artificial Sequence
  synthetic [barcode part1]
gtccgaactcgtcact

SEQ ID NO: 42919 - DNA, 16 bp, Artificial Sequence
  synthetic [barcode part1]
attctcaccgccagac

SEQ ID NO: 42920 - DNA, 16 bp, Artificial Sequence
  synthetic [barcode part1]
tatcgcctattagtgc

SEQ ID NO: 42921 - DNA, 16 bp, Artificial Sequence
  synthetic [barcode part1]
tcctcgtgtggttcag

SEQ ID NO: 42922 - DNA, 16 bp, Artificial Sequence
  synthetic [barcode part1]
gacaaggcgtggattc

SEQ ID NO: 42923 - DNA, 16 bp, Artificial Sequence
  synthetic [barcode part1]
aatacttccgtcgttg

SEQ ID NO: 42924 - DNA, 16 bp, Artificial Sequence
  synthetic [barcode part1]
cgcactggatcttctg

SEQ ID NO: 42925 - DNA, 16 bp, Artificial Sequence
  synthetic [barcode part1]
acgagaggacctaacc

SEQ ID NO: 42926 - DNA, 16 bp, Artificial Sequence
  synthetic [barcode part1]
cgtccacacttactct

SEQ ID NO: 42927 - DNA, 16 bp, Artificial Sequence
  synthetic [barcode part1]
gaacgtctctactgtt

SEQ ID NO: 42928 - DNA, 16 bp, Artificial Sequence
  synthetic [barcode part1]
agaggacagatacttc

SEQ ID NO: 42929 - DNA, 16 bp, Artificial Sequence
  synthetic [barcode part1]
gtgtaatagaaccggt

SEQ ID NO: 42930 - DNA, 16 bp, Artificial Sequence
  synthetic [barcode part1]
acgcgtgtgtatacac

SEQ ID NO: 42931 - DNA, 16 bp, Artificial Sequence
  synthetic [barcode part1]
ccttgacacgttcgac

SEQ ID NO: 42932 - DNA, 16 bp, Artificial Sequence
  synthetic [barcode part1]
actgatcacaccgtag

SEQ ID NO: 42933 - DNA, 16 bp, Artificial Sequence
  synthetic [barcode part1]
attccttgcacgttag

SEQ ID NO: 42934 - DNA, 16 bp, Artificial Sequence
  synthetic [barcode part1]
aggaacctggtacgtg

SEQ ID NO: 42935 - DNA, 16 bp, Artificial Sequence
  synthetic [barcode part1]
tccgccaagttgtatt

SEQ ID NO: 42936 - DNA, 16 bp, Artificial Sequence
  synthetic [barcode part1]
gcagaacagactcacg

SEQ ID NO: 42937 - DNA, 16 bp, Artificial Sequence
  synthetic [barcode part1]
taatcgcgcaaggcag

SEQ ID NO: 42938 - DNA, 16 bp, Artificial Sequence
  synthetic [barcode part1]
tcaagacgaaccttgc

SEQ ID NO: 42939 - DNA, 16 bp, Artificial Sequence
  synthetic [barcode part1]
gcgaactccttgtcgt

SEQ ID NO: 42940 - DNA, 16 bp, Artificial Sequence
  synthetic [barcode part1]
caagatccgtagtacc

SEQ ID NO: 42941 - DNA, 16 bp, Artificial Sequence
  synthetic [barcode part1]
agtggagtcagatatc

SEQ ID NO: 42942 - DNA, 16 bp, Artificial Sequence
  synthetic [barcode part1]
tacttcgcggacacct

SEQ ID NO: 42943 - DNA, 16 bp, Artificial Sequence
  synthetic [barcode part1]
gcagttatctcaatcc

SEQ ID NO: 42944 - DNA, 16 bp, Artificial Sequence
  synthetic [barcode part1]
taattctcgcgactgt

SEQ ID NO: 42945 - DNA, 16 bp, Artificial Sequence
  synthetic [barcode part1]
tctcaagaacgagtag

SEQ ID NO: 42946 - DNA, 16 bp, Artificial Sequence
  synthetic [barcode part1]
atccaaggaacctacc

SEQ ID NO: 42947 - DNA, 16 bp, Artificial Sequence
  synthetic [barcode part1]
aaggagaaccgatcag

SEQ ID NO: 42948 - DNA, 16 bp, Artificial Sequence
  synthetic [barcode part1]
attatccttcgagtgc

SEQ ID NO: 42949 - DNA, 16 bp, Artificial Sequence
  synthetic [barcode part1]
cgtgattaactgcacg

SEQ ID NO: 42950 - DNA, 16 bp, Artificial Sequence
  synthetic [barcode part1]
acttataccggtgcag

SEQ ID NO: 42951 - DNA, 16 bp, Artificial Sequence
  synthetic [barcode part1]
tacctgtaacaccact

SEQ ID NO: 42952 - DNA, 16 bp, Artificial Sequence
  synthetic [barcode part1]
gtacctcctagtaatc

SEQ ID NO: 42953 - DNA, 16 bp, Artificial Sequence
  synthetic [barcode part1]
gtgaggttgagtgtcg

SEQ ID NO: 42954 - DNA, 16 bp, Artificial Sequence
  synthetic [barcode part1]
ccttcgagtacactgc

SEQ ID NO: 42955 - DNA, 16 bp, Artificial Sequence
  synthetic [barcode part1]
gttagtcacgtgtacg

SEQ ID NO: 42956 - DNA, 16 bp, Artificial Sequence
  synthetic [barcode part1]
tgacgaggtggattcg

SEQ ID NO: 42957 - DNA, 16 bp, Artificial Sequence
  synthetic [barcode part1]
ttacggtgattgaccg

SEQ ID NO: 42958 - DNA, 16 bp, Artificial Sequence
  synthetic [barcode part1]
cagaatactgcacaag

SEQ ID NO: 42959 - DNA, 16 bp, Artificial Sequence
  synthetic [barcode part1]
aagagtgtaggtcgtt

SEQ ID NO: 42960 - DNA, 16 bp, Artificial Sequence
  synthetic [barcode part1]
gtactctgcgttcctt

SEQ ID NO: 42961 - DNA, 16 bp, Artificial Sequence
  synthetic [barcode part1]
gtggtgtctagttggt

SEQ ID NO: 42962 - DNA, 16 bp, Artificial Sequence
  synthetic [barcode part1]
ttcctcgccacacaag

SEQ ID NO: 42963 - DNA, 16 bp, Artificial Sequence
  synthetic [barcode part1]
actcctgtctaacaac

SEQ ID NO: 42964 - DNA, 16 bp, Artificial Sequence
  synthetic [barcode part1]
cgcagaacaacagtcg

SEQ ID NO: 42965 - DNA, 16 bp, Artificial Sequence
  synthetic [barcode part1]
tccgataggtgcagag

SEQ ID NO: 42966 - DNA, 16 bp, Artificial Sequence
  synthetic [barcode part1]
ccaatagtaccggatc

SEQ ID NO: 42967 - DNA, 16 bp, Artificial Sequence
  synthetic [barcode part1]
cagagtgtctaatccg

SEQ ID NO: 42968 - DNA, 16 bp, Artificial Sequence
  synthetic [barcode part1]
aagttgtcctggtggt

SEQ ID NO: 42969 - DNA, 16 bp, Artificial Sequence
  synthetic [barcode part1]
actatcgcgatctgag

SEQ ID NO: 42970 - DNA, 16 bp, Artificial Sequence
  synthetic [barcode part1]
actcgcctctggagtt

SEQ ID NO: 42971 - DNA, 16 bp, Artificial Sequence
  synthetic [barcode part1]
gcgtccaagtaaggtg

SEQ ID NO: 42972 - DNA, 16 bp, Artificial Sequence
  synthetic [barcode part1]
agactgcctcgtgtct

SEQ ID NO: 42973 - DNA, 16 bp, Artificial Sequence
  synthetic [barcode part1]
caagatattgcgtgag

SEQ ID NO: 42974 - DNA, 16 bp, Artificial Sequence
  synthetic [barcode part1]
agtccgaaggagtatt

SEQ ID NO: 42975 - DNA, 16 bp, Artificial Sequence
  synthetic [barcode part1]
cacctcacgagtactc

SEQ ID NO: 42976 - DNA, 16 bp, Artificial Sequence
  synthetic [barcode part1]
atatcaacggtaaggc

SEQ ID NO: 42977 - DNA, 16 bp, Artificial Sequence
  synthetic [barcode part1]
gttattctgagacggc

SEQ ID NO: 42978 - DNA, 16 bp, Artificial Sequence
  synthetic [barcode part1]
acaaggaacgcagagt

SEQ ID NO: 42979 - DNA, 16 bp, Artificial Sequence
  synthetic [barcode part1]
aagactcaacagacac

SEQ ID NO: 42980 - DNA, 16 bp, Artificial Sequence
  synthetic [barcode part1]
gcacggttaactacac

SEQ ID NO: 42981 - DNA, 16 bp, Artificial Sequence
  synthetic [barcode part1]
atcaggcgttcagtgt

SEQ ID NO: 42982 - DNA, 16 bp, Artificial Sequence
  synthetic [barcode part1]
gcacttcactactggc

SEQ ID NO: 42983 - DNA, 16 bp, Artificial Sequence
  synthetic [barcode part1]
gaagtggcactcgaac

SEQ ID NO: 42984 - DNA, 16 bp, Artificial Sequence
  synthetic [barcode part1]
tactccggacaagatc

SEQ ID NO: 42985 - DNA, 16 bp, Artificial Sequence
  synthetic [barcode part1]
tctggtcaccgatacc

SEQ ID NO: 42986 - DNA, 16 bp, Artificial Sequence
  synthetic [barcode part1]
atcggcgcagagaatc

SEQ ID NO: 42987 - DNA, 16 bp, Artificial Sequence
  synthetic [barcode part1]
cacacgaagaccaggt

SEQ ID NO: 42988 - DNA, 16 bp, Artificial Sequence
  synthetic [barcode part1]
attgccactggatcag

SEQ ID NO: 42989 - DNA, 16 bp, Artificial Sequence
  synthetic [barcode part1]
gaactaacgtggttag

SEQ ID NO: 42990 - DNA, 16 bp, Artificial Sequence
  synthetic [barcode part1]
ttacgttgacgtaggc

SEQ ID NO: 42991 - DNA, 16 bp, Artificial Sequence
  synthetic [barcode part1]
ttcaccgtagtggaac

SEQ ID NO: 42992 - DNA, 16 bp, Artificial Sequence
  synthetic [barcode part1]
aagtctcaggatctcg

SEQ ID NO: 42993 - DNA, 16 bp, Artificial Sequence
  synthetic [barcode part1]
cgaacttctcgtcacg

SEQ ID NO: 42994 - DNA, 16 bp, Artificial Sequence
  synthetic [barcode part1]
agtgaatagtaccgtg

SEQ ID NO: 42995 - DNA, 16 bp, Artificial Sequence
  synthetic [barcode part1]
gagtgttggtacttgc

SEQ ID NO: 42996 - DNA, 16 bp, Artificial Sequence
  synthetic [barcode part1]
gaacaccagactcact

SEQ ID NO: 42997 - DNA, 16 bp, Artificial Sequence
  synthetic [barcode part1]
cgtaccgactaatacg

SEQ ID NO: 42998 - DNA, 16 bp, Artificial Sequence
  synthetic [barcode part1]
cctcagtccggatatc

SEQ ID NO: 42999 - DNA, 16 bp, Artificial Sequence
  synthetic [barcode part1]
gtcctaacgtgtgtag

SEQ ID NO: 43000 - DNA, 16 bp, Artificial Sequence
  synthetic [barcode part1]
accgagtgaactgtct

SEQ ID NO: 43001 - DNA, 16 bp, Artificial Sequence
  synthetic [barcode part1]
cactggataggtcact

SEQ ID NO: 43002 - DNA, 16 bp, Artificial Sequence
  synthetic [barcode part1]
attgacacctgcaggt

SEQ ID NO: 43003 - DNA, 16 bp, Artificial Sequence
  synthetic [barcode part1]
atagattcggtccttc

SEQ ID NO: 43004 - DNA, 16 bp, Artificial Sequence
  synthetic [barcode part1]
cgttaagtagaggtac

SEQ ID NO: 43005 - DNA, 16 bp, Artificial Sequence
  synthetic [barcode part1]
ccgtatcttacacctc

SEQ ID NO: 43006 - DNA, 16 bp, Artificial Sequence
  synthetic [barcode part1]
acctaccgaatcctgc

SEQ ID NO: 43007 - DNA, 16 bp, Artificial Sequence
  synthetic [barcode part1]
atcctccgacttcttg

SEQ ID NO: 43008 - DNA, 16 bp, Artificial Sequence
  synthetic [barcode part1]
ttacctattgcctgcc

SEQ ID NO: 43009 - DNA, 16 bp, Artificial Sequence
  synthetic [barcode part1]
gttgccttgagtgtcc

SEQ ID NO: 43010 - DNA, 16 bp, Artificial Sequence
  synthetic [barcode part1]
gagaagtgtggccgtt

SEQ ID NO: 43011 - DNA, 16 bp, Artificial Sequence
  synthetic [barcode part1]
cggtaagtagatactg

SEQ ID NO: 43012 - DNA, 16 bp, Artificial Sequence
  synthetic [barcode part1]
attggacaagtcgtcc

SEQ ID NO: 43013 - DNA, 16 bp, Artificial Sequence
  synthetic [barcode part1]
ccaacgcaactggaag

SEQ ID NO: 43014 - DNA, 16 bp, Artificial Sequence
  synthetic [barcode part1]
gtccaggtaagtgttc

SEQ ID NO: 43015 - DNA, 16 bp, Artificial Sequence
  synthetic [barcode part1]
tgtgttgcaacacgtg

SEQ ID NO: 43016 - DNA, 16 bp, Artificial Sequence
  synthetic [barcode part1]
tgagtcgcgtgagagt

SEQ ID NO: 43017 - DNA, 16 bp, Artificial Sequence
  synthetic [barcode part1]
acagacgacggtactg

SEQ ID NO: 43018 - DNA, 16 bp, Artificial Sequence
  synthetic [barcode part1]
acaggttcacaagtcc

SEQ ID NO: 43019 - DNA, 16 bp, Artificial Sequence
  synthetic [barcode part1]
cgttagacctagtgac

SEQ ID NO: 43020 - DNA, 16 bp, Artificial Sequence
  synthetic [barcode part1]
gtggttattccagttc

SEQ ID NO: 43021 - DNA, 16 bp, Artificial Sequence
  synthetic [barcode part1]
gtcttcagagtgcagt

SEQ ID NO: 43022 - DNA, 16 bp, Artificial Sequence
  synthetic [barcode part1]
acctcctcttcttgag

SEQ ID NO: 43023 - DNA, 16 bp, Artificial Sequence
  synthetic [barcode part1]
tcgcgcacttcaatcg

SEQ ID NO: 43024 - DNA, 16 bp, Artificial Sequence
  synthetic [barcode part1]
acggtgatatcagtag

SEQ ID NO: 43025 - DNA, 16 bp, Artificial Sequence
  synthetic [barcode part1]
aagtgaactacgacac

SEQ ID NO: 43026 - DNA, 16 bp, Artificial Sequence
  synthetic [barcode part1]
tcactcaactctgagt

SEQ ID NO: 43027 - DNA, 16 bp, Artificial Sequence
  synthetic [barcode part1]
aggtattcaggcacct

SEQ ID NO: 43028 - DNA, 16 bp, Artificial Sequence
  synthetic [barcode part1]
cgttcgcacgatacct

SEQ ID NO: 43029 - DNA, 16 bp, Artificial Sequence
  synthetic [barcode part1]
cgaacacacacgactt

SEQ ID NO: 43030 - DNA, 16 bp, Artificial Sequence
  synthetic [barcode part1]
gtccgtcagtgttatt

SEQ ID NO: 43031 - DNA, 16 bp, Artificial Sequence
  synthetic [barcode part1]
tcttgtgcggcgactt

SEQ ID NO: 43032 - DNA, 16 bp, Artificial Sequence
  synthetic [barcode part1]
ccgatctgtgagatac

SEQ ID NO: 43033 - DNA, 16 bp, Artificial Sequence
  synthetic [barcode part1]
cgcacaagtctcctgt

SEQ ID NO: 43034 - DNA, 16 bp, Artificial Sequence
  synthetic [barcode part1]
aggattcgcctgtctc

SEQ ID NO: 43035 - DNA, 16 bp, Artificial Sequence
  synthetic [barcode part1]
caggcctataacggag

SEQ ID NO: 43036 - DNA, 16 bp, Artificial Sequence
  synthetic [barcode part1]
gcctgttccgtgatac

SEQ ID NO: 43037 - DNA, 16 bp, Artificial Sequence
  synthetic [barcode part1]
ttgagtagtctcgtct

SEQ ID NO: 43038 - DNA, 16 bp, Artificial Sequence
  synthetic [barcode part1]
tggcctgtgttctcag

SEQ ID NO: 43039 - DNA, 16 bp, Artificial Sequence
  synthetic [barcode part1]
ataagtccgatctcct

SEQ ID NO: 43040 - DNA, 16 bp, Artificial Sequence
  synthetic [barcode part1]
taatcctgcgtactac

SEQ ID NO: 43041 - DNA, 16 bp, Artificial Sequence
  synthetic [barcode part1]
gactccttctcgttac

SEQ ID NO: 43042 - DNA, 16 bp, Artificial Sequence
  synthetic [barcode part1]
ataggcctacgagtct

SEQ ID NO: 43043 - DNA, 16 bp, Artificial Sequence
  synthetic [barcode part1]
cgttgtcttatcgtcc

SEQ ID NO: 43044 - DNA, 16 bp, Artificial Sequence
  synthetic [barcode part1]
gacgatccacactcct

SEQ ID NO: 43045 - DNA, 16 bp, Artificial Sequence
  synthetic [barcode part1]
tgaggttcctcagaac

SEQ ID NO: 43046 - DNA, 16 bp, Artificial Sequence
  synthetic [barcode part1]
acctaggattctacct

SEQ ID NO: 43047 - DNA, 16 bp, Artificial Sequence
  synthetic [barcode part1]
gtaatcgacgtcaacc

SEQ ID NO: 43048 - DNA, 16 bp, Artificial Sequence
  synthetic [barcode part1]
aggttgtacttctacc

SEQ ID NO: 43049 - DNA, 16 bp, Artificial Sequence
  synthetic [barcode part1]
agttgcgtctctcggt

SEQ ID NO: 43050 - DNA, 16 bp, Artificial Sequence
  synthetic [barcode part1]
cctacgtctagtgacc

SEQ ID NO: 43051 - DNA, 16 bp, Artificial Sequence
  synthetic [barcode part1]
aattcggagagacgcc

SEQ ID NO: 43052 - DNA, 16 bp, Artificial Sequence
  synthetic [barcode part1]
gcactctattgttgac

SEQ ID NO: 43053 - DNA, 16 bp, Artificial Sequence
  synthetic [barcode part1]
tgttcgagaggcagtg

SEQ ID NO: 43054 - DNA, 16 bp, Artificial Sequence
  synthetic [barcode part1]
tcaagtacgcctgagt

SEQ ID NO: 43055 - DNA, 16 bp, Artificial Sequence
  synthetic [barcode part1]
agtcgtgttgactctt

SEQ ID NO: 43056 - DNA, 16 bp, Artificial Sequence
  synthetic [barcode part1]
aagactcagtaggtac

SEQ ID NO: 43057 - DNA, 16 bp, Artificial Sequence
  synthetic [barcode part1]
cagtcttgtgtgccgt

SEQ ID NO: 43058 - DNA, 16 bp, Artificial Sequence
  synthetic [barcode part1]
cgtcaattgcgtaacg

SEQ ID NO: 43059 - DNA, 16 bp, Artificial Sequence
  synthetic [barcode part1]
gttgacagagtgttcc

SEQ ID NO: 43060 - DNA, 16 bp, Artificial Sequence
  synthetic [barcode part1]
aagtgaggcaagtggt

SEQ ID NO: 43061 - DNA, 16 bp, Artificial Sequence
  synthetic [barcode part1]
gatcagtatcgtgacc

SEQ ID NO: 43062 - DNA, 16 bp, Artificial Sequence
  synthetic [barcode part1]
tacaggcgacgagact

SEQ ID NO: 43063 - DNA, 16 bp, Artificial Sequence
  synthetic [barcode part1]
gttattcggatccgcc

SEQ ID NO: 43064 - DNA, 16 bp, Artificial Sequence
  synthetic [barcode part1]
cgatcagatcgcagtt

SEQ ID NO: 43065 - DNA, 16 bp, Artificial Sequence
  synthetic [barcode part1]
cgttaccttatacgac

SEQ ID NO: 43066 - DNA, 16 bp, Artificial Sequence
  synthetic [barcode part1]
tgactccttctgactc

SEQ ID NO: 43067 - DNA, 16 bp, Artificial Sequence
  synthetic [barcode part1]
gtcgcaactatctgtt

SEQ ID NO: 43068 - DNA, 16 bp, Artificial Sequence
  synthetic [barcode part1]
gtcctctcgtggttag

SEQ ID NO: 43069 - DNA, 16 bp, Artificial Sequence
  synthetic [barcode part1]
tatcggttaacgtgcg

SEQ ID NO: 43070 - DNA, 16 bp, Artificial Sequence
  synthetic [barcode part1]
gttgtccaatactcac

SEQ ID NO: 43071 - DNA, 16 bp, Artificial Sequence
  synthetic [barcode part1]
gtgtctcaggaatacc

SEQ ID NO: 43072 - DNA, 16 bp, Artificial Sequence
  synthetic [barcode part1]
tgtctcaactcgtagt

SEQ ID NO: 43073 - DNA, 16 bp, Artificial Sequence
  synthetic [barcode part1]
cgttagtgcgttaacg

SEQ ID NO: 43074 - DNA, 16 bp, Artificial Sequence
  synthetic [barcode part1]
tctaacttcggtcctc

SEQ ID NO: 43075 - DNA, 16 bp, Artificial Sequence
  synthetic [barcode part1]
gtgttcagagttcacg

SEQ ID NO: 43076 - DNA, 16 bp, Artificial Sequence
  synthetic [barcode part1]
attcaaggtgacgagt

SEQ ID NO: 43077 - DNA, 16 bp, Artificial Sequence
  synthetic [barcode part1]
taacggcactggactt

SEQ ID NO: 43078 - DNA, 16 bp, Artificial Sequence
  synthetic [barcode part1]
cgtgacgatagacgac

SEQ ID NO: 43079 - DNA, 16 bp, Artificial Sequence
  synthetic [barcode part1]
ttcctccgttgcagtt

SEQ ID NO: 43080 - DNA, 16 bp, Artificial Sequence
  synthetic [barcode part1]
aaggtggatccgcaac

SEQ ID NO: 43081 - DNA, 16 bp, Artificial Sequence
  synthetic [barcode part1]
gttattcctgcaggcc

SEQ ID NO: 43082 - DNA, 16 bp, Artificial Sequence
  synthetic [barcode part1]
cgtgttagattaggag

SEQ ID NO: 43083 - DNA, 16 bp, Artificial Sequence
  synthetic [barcode part1]
ccagttatccttcctg

SEQ ID NO: 43084 - DNA, 16 bp, Artificial Sequence
  synthetic [barcode part1]
ccgttattacctaggt

SEQ ID NO: 43085 - DNA, 16 bp, Artificial Sequence
  synthetic [barcode part1]
gaccacgaaggtcaac

SEQ ID NO: 43086 - DNA, 16 bp, Artificial Sequence
  synthetic [barcode part1]
aatctctcacgagttc

SEQ ID NO: 43087 - DNA, 16 bp, Artificial Sequence
  synthetic [barcode part1]
ccgttctggcctatag

SEQ ID NO: 43088 - DNA, 16 bp, Artificial Sequence
  synthetic [barcode part1]
gcggatcggagtaatc

SEQ ID NO: 43089 - DNA, 16 bp, Artificial Sequence
  synthetic [barcode part1]
tcgacaggacacgagt

SEQ ID NO: 43090 - DNA, 16 bp, Artificial Sequence
  synthetic [barcode part1]
gtaatcctccaacgag

SEQ ID NO: 43091 - DNA, 16 bp, Artificial Sequence
  synthetic [barcode part1]
gtacaggatccaatag

SEQ ID NO: 43092 - DNA, 16 bp, Artificial Sequence
  synthetic [barcode part1]
acgtcaacacggattc

SEQ ID NO: 43093 - DNA, 16 bp, Artificial Sequence
  synthetic [barcode part1]
agtctctgattgcgtt

SEQ ID NO: 43094 - DNA, 16 bp, Artificial Sequence
  synthetic [barcode part1]
cggtgtcacggataag

SEQ ID NO: 43095 - DNA, 16 bp, Artificial Sequence
  synthetic [barcode part1]
acacctactaccttag

SEQ ID NO: 43096 - DNA, 16 bp, Artificial Sequence
  synthetic [barcode part1]
tactcgagatctgcag

SEQ ID NO: 43097 - DNA, 16 bp, Artificial Sequence
  synthetic [barcode part1]
aatccttcgacaggac

SEQ ID NO: 43098 - DNA, 16 bp, Artificial Sequence
  synthetic [barcode part1]
caaggagtacgatcgc

SEQ ID NO: 43099 - DNA, 16 bp, Artificial Sequence
  synthetic [barcode part1]
agagtctgcgatatcc

SEQ ID NO: 43100 - DNA, 16 bp, Artificial Sequence
  synthetic [barcode part1]
tgacttccggtcgtgt

SEQ ID NO: 43101 - DNA, 16 bp, Artificial Sequence
  synthetic [barcode part1]
cgataggttgtaagtg

SEQ ID NO: 43102 - DNA, 16 bp, Artificial Sequence
  synthetic [barcode part1]
aaccgcctgaattgtg

SEQ ID NO: 43103 - DNA, 16 bp, Artificial Sequence
  synthetic [barcode part1]
tcttaacgtgcctggc

SEQ ID NO: 43104 - DNA, 16 bp, Artificial Sequence
  synthetic [barcode part1]
ccaatctccgttacct

SEQ ID NO: 43105 - DNA, 16 bp, Artificial Sequence
  synthetic [barcode part1]
aatcgaacagaaggcg

SEQ ID NO: 43106 - DNA, 16 bp, Artificial Sequence
  synthetic [barcode part1]
cgtccgttgttcactt

SEQ ID NO: 43107 - DNA, 16 bp, Artificial Sequence
  synthetic [barcode part1]
gatcggtaacttcggt

SEQ ID NO: 43108 - DNA, 16 bp, Artificial Sequence
  synthetic [barcode part1]
gacagtgcgaatattg

SEQ ID NO: 43109 - DNA, 16 bp, Artificial Sequence
  synthetic [barcode part1]
tgcgtctgacgacttc

SEQ ID NO: 43110 - DNA, 16 bp, Artificial Sequence
  synthetic [barcode part1]
tgttataacgtgcgcg

SEQ ID NO: 43111 - DNA, 16 bp, Artificial Sequence
  synthetic [barcode part1]
tgtactccgagttact

SEQ ID NO: 43112 - DNA, 16 bp, Artificial Sequence
  synthetic [barcode part1]
actgaacctatactcc

SEQ ID NO: 43113 - DNA, 16 bp, Artificial Sequence
  synthetic [barcode part1]
gcgacgtattaaccac

SEQ ID NO: 43114 - DNA, 16 bp, Artificial Sequence
  synthetic [barcode part1]
gtgacagatctaagtg

SEQ ID NO: 43115 - DNA, 16 bp, Artificial Sequence
  synthetic [barcode part1]
tggaatctcctaaggc

SEQ ID NO: 43116 - DNA, 16 bp, Artificial Sequence
  synthetic [barcode part1]
gactaacggtcagttc

SEQ ID NO: 43117 - DNA, 16 bp, Artificial Sequence
  synthetic [barcode part1]
cgagaggtgtgtggtt

SEQ ID NO: 43118 - DNA, 16 bp, Artificial Sequence
  synthetic [barcode part1]
ttatcacgtggtaggc

SEQ ID NO: 43119 - DNA, 16 bp, Artificial Sequence
  synthetic [barcode part1]
tcttggtacacggcct

SEQ ID NO: 43120 - DNA, 16 bp, Artificial Sequence
  synthetic [barcode part1]
tgtggtggttccaagt

SEQ ID NO: 43121 - DNA, 16 bp, Artificial Sequence
  synthetic [barcode part1]
taactgcgacaacaag

SEQ ID NO: 43122 - DNA, 16 bp, Artificial Sequence
  synthetic [barcode part1]
tcttgttgagttcacg

SEQ ID NO: 43123 - DNA, 16 bp, Artificial Sequence
  synthetic [barcode part1]
gaacgttcggatactc

SEQ ID NO: 43124 - DNA, 16 bp, Artificial Sequence
  synthetic [barcode part1]
gacaggaatacggtcc

SEQ ID NO: 43125 - DNA, 16 bp, Artificial Sequence
  synthetic [barcode part1]
agacctacctacgaac

SEQ ID NO: 43126 - DNA, 16 bp, Artificial Sequence
  synthetic [barcode part1]
gacttgtcgaacgttg

SEQ ID NO: 43127 - DNA, 16 bp, Artificial Sequence
  synthetic [barcode part1]
aacaggatcaacgtgt

SEQ ID NO: 43128 - DNA, 16 bp, Artificial Sequence
  synthetic [barcode part1]
tgaggagtacggtcac

SEQ ID NO: 43129 - DNA, 16 bp, Artificial Sequence
  synthetic [barcode part1]
tggtgtacttcgccac

SEQ ID NO: 43130 - DNA, 16 bp, Artificial Sequence
  synthetic [barcode part1]
tcaaggtcaccgtaac

SEQ ID NO: 43131 - DNA, 16 bp, Artificial Sequence
  synthetic [barcode part1]
tcagtgtacgtcagtg

SEQ ID NO: 43132 - DNA, 16 bp, Artificial Sequence
  synthetic [barcode part1]
ttagattcggtccgag

SEQ ID NO: 43133 - DNA, 16 bp, Artificial Sequence
  synthetic [barcode part1]
accggaacggtatacg

SEQ ID NO: 43134 - DNA, 16 bp, Artificial Sequence
  synthetic [barcode part1]
gtaatatccggtcgac

SEQ ID NO: 43135 - DNA, 16 bp, Artificial Sequence
  synthetic [barcode part1]
gaagacgacctgacac

SEQ ID NO: 43136 - DNA, 16 bp, Artificial Sequence
  synthetic [barcode part1]
attcacttcacgacac

SEQ ID NO: 43137 - DNA, 16 bp, Artificial Sequence
  synthetic [barcode part1]
tgcgagttgagatagt

SEQ ID NO: 43138 - DNA, 16 bp, Artificial Sequence
  synthetic [barcode part1]
cggaggaagttctctt

SEQ ID NO: 43139 - DNA, 16 bp, Artificial Sequence
  synthetic [barcode part1]
tagacaagttctggag

SEQ ID NO: 43140 - DNA, 16 bp, Artificial Sequence
  synthetic [barcode part1]
gatacgcctggagagt

SEQ ID NO: 43141 - DNA, 16 bp, Artificial Sequence
  synthetic [barcode part1]
tactcacactcgtcct

SEQ ID NO: 43142 - DNA, 16 bp, Artificial Sequence
  synthetic [barcode part1]
gaatagagtggacgac

SEQ ID NO: 43143 - DNA, 16 bp, Artificial Sequence
  synthetic [barcode part1]
tgacagtagtctgacc

SEQ ID NO: 43144 - DNA, 16 bp, Artificial Sequence
  synthetic [barcode part1]
caagttgcagtctgac

SEQ ID NO: 43145 - DNA, 16 bp, Artificial Sequence
  synthetic [barcode part1]
ccaacgacaccttcgt

SEQ ID NO: 43146 - DNA, 16 bp, Artificial Sequence
  synthetic [barcode part1]
tattagtacgccggtg

SEQ ID NO: 43147 - DNA, 16 bp, Artificial Sequence
  synthetic [barcode part1]
tgtcaaggtccttgcc

SEQ ID NO: 43148 - DNA, 16 bp, Artificial Sequence
  synthetic [barcode part1]
gagactcgcgatatct

SEQ ID NO: 43149 - DNA, 16 bp, Artificial Sequence
  synthetic [barcode part1]
ttaagttcgtgttccg

SEQ ID NO: 43150 - DNA, 16 bp, Artificial Sequence
  synthetic [barcode part1]
gtcgcctatcttgtct

SEQ ID NO: 43151 - DNA, 16 bp, Artificial Sequence
  synthetic [barcode part1]
gtcttaggaagtctcg

SEQ ID NO: 43152 - DNA, 16 bp, Artificial Sequence
  synthetic [barcode part1]
atctcacgcagttgtt

SEQ ID NO: 43153 - DNA, 16 bp, Artificial Sequence
  synthetic [barcode part1]
accaataccgtcgcct

SEQ ID NO: 43154 - DNA, 16 bp, Artificial Sequence
  synthetic [barcode part1]
tactaggacttctgtc

SEQ ID NO: 43155 - DNA, 16 bp, Artificial Sequence
  synthetic [barcode part1]
gcgtcgatataagtcc

SEQ ID NO: 43156 - DNA, 16 bp, Artificial Sequence
  synthetic [barcode part1]
cgcgataagatctcgt

SEQ ID NO: 43157 - DNA, 16 bp, Artificial Sequence
  synthetic [barcode part1]
aacaagaccggtgtgc

SEQ ID NO: 43158 - DNA, 16 bp, Artificial Sequence
  synthetic [barcode part1]
taatcaacgtggtgcc

SEQ ID NO: 43159 - DNA, 16 bp, Artificial Sequence
  synthetic [barcode part1]
gacgtataccgatacc

SEQ ID NO: 43160 - DNA, 16 bp, Artificial Sequence
  synthetic [barcode part1]
tcctgcgagttcgact

SEQ ID NO: 43161 - DNA, 16 bp, Artificial Sequence
  synthetic [barcode part1]
cggaagagttgcacac

SEQ ID NO: 43162 - DNA, 16 bp, Artificial Sequence
  synthetic [barcode part1]
gttagtccagtcaacg

SEQ ID NO: 43163 - DNA, 16 bp, Artificial Sequence
  synthetic [barcode part1]
tcgtctgatccacttc

SEQ ID NO: 43164 - DNA, 16 bp, Artificial Sequence
  synthetic [barcode part1]
tattcacctcaggatc

SEQ ID NO: 43165 - DNA, 16 bp, Artificial Sequence
  synthetic [barcode part1]
tgactcttgcgaccgt

SEQ ID NO: 43166 - DNA, 16 bp, Artificial Sequence
  synthetic [barcode part1]
gtgtgcggttataacc

SEQ ID NO: 43167 - DNA, 16 bp, Artificial Sequence
  synthetic [barcode part1]
agtcacacagtgtgtc

SEQ ID NO: 43168 - DNA, 16 bp, Artificial Sequence
  synthetic [barcode part1]
ccgtggaggattgaac

SEQ ID NO: 43169 - DNA, 16 bp, Artificial Sequence
  synthetic [barcode part1]
tgcaatacgtctacct

SEQ ID NO: 43170 - DNA, 16 bp, Artificial Sequence
  synthetic [barcode part1]
tatatccgcagttcac

SEQ ID NO: 43171 - DNA, 16 bp, Artificial Sequence
  synthetic [barcode part1]
cgagactaccacagtt

SEQ ID NO: 43172 - DNA, 16 bp, Artificial Sequence
  synthetic [barcode part1]
attactcgcgacgaac

SEQ ID NO: 43173 - DNA, 16 bp, Artificial Sequence
  synthetic [barcode part1]
gagtatatcagaccag

SEQ ID NO: 43174 - DNA, 16 bp, Artificial Sequence
  synthetic [barcode part1]
cggtgaacactattcg

SEQ ID NO: 43175 - DNA, 16 bp, Artificial Sequence
  synthetic [barcode part1]
gacttacctcggatag

SEQ ID NO: 43176 - DNA, 16 bp, Artificial Sequence
  synthetic [barcode part1]
gtcgttcaagtggtac

SEQ ID NO: 43177 - DNA, 16 bp, Artificial Sequence
  synthetic [barcode part1]
acttactcgtccactc

SEQ ID NO: 43178 - DNA, 16 bp, Artificial Sequence
  synthetic [barcode part1]
gtggattagttgtgcc

SEQ ID NO: 43179 - DNA, 16 bp, Artificial Sequence
  synthetic [barcode part1]
agagattgcgtactag

SEQ ID NO: 43180 - DNA, 16 bp, Artificial Sequence
  synthetic [barcode part1]
gaggaaccaccttatc

SEQ ID NO: 43181 - DNA, 16 bp, Artificial Sequence
  synthetic [barcode part1]
accactaattgccgag

SEQ ID NO: 43182 - DNA, 16 bp, Artificial Sequence
  synthetic [barcode part1]
gttaaccagtcagtcg

SEQ ID NO: 43183 - DNA, 16 bp, Artificial Sequence
  synthetic [barcode part1]
ccgcctaagattccgt

SEQ ID NO: 43184 - DNA, 16 bp, Artificial Sequence
  synthetic [barcode part1]
acaagaactaggttgc

SEQ ID NO: 43185 - DNA, 16 bp, Artificial Sequence
  synthetic [barcode part1]
taactggcggtcaatc

SEQ ID NO: 43186 - DNA, 16 bp, Artificial Sequence
  synthetic [barcode part1]
tctcacgattgtcggc

SEQ ID NO: 43187 - DNA, 16 bp, Artificial Sequence
  synthetic [barcode part1]
aagtaaggacgccacc

SEQ ID NO: 43188 - DNA, 16 bp, Artificial Sequence
  synthetic [barcode part1]
tcaggcgaatatccac

SEQ ID NO: 43189 - DNA, 16 bp, Artificial Sequence
  synthetic [barcode part1]
tagtgcaccaacacac

SEQ ID NO: 43190 - DNA, 16 bp, Artificial Sequence
  synthetic [barcode part1]
tgtaagacagtagtcg

SEQ ID NO: 43191 - DNA, 16 bp, Artificial Sequence
  synthetic [barcode part1]
gacgtgtactggtact

SEQ ID NO: 43192 - DNA, 16 bp, Artificial Sequence
  synthetic [barcode part1]
gaacaggtcacggtac

SEQ ID NO: 43193 - DNA, 16 bp, Artificial Sequence
  synthetic [barcode part1]
tcacgagttgcgtagt

SEQ ID NO: 43194 - DNA, 16 bp, Artificial Sequence
  synthetic [barcode part1]
cagaagacaaccgcgt

SEQ ID NO: 43195 - DNA, 16 bp, Artificial Sequence
  synthetic [barcode part1]
caacaatcggttcggt

SEQ ID NO: 43196 - DNA, 16 bp, Artificial Sequence
  synthetic [barcode part1]
tgtggacaagtccgtt

SEQ ID NO: 43197 - DNA, 16 bp, Artificial Sequence
  synthetic [barcode part1]
aggtgtccggagtagt

SEQ ID NO: 43198 - DNA, 16 bp, Artificial Sequence
  synthetic [barcode part1]
ttgacagaacgcggac

SEQ ID NO: 43199 - DNA, 16 bp, Artificial Sequence
  synthetic [barcode part1]
gttagaacacaaccag

SEQ ID NO: 43200 - DNA, 16 bp, Artificial Sequence
  synthetic [barcode part1]
cgtcgtggattaatcg

SEQ ID NO: 43201 - DNA, 16 bp, Artificial Sequence
  synthetic [barcode part1]
gtctcgttattccacc

SEQ ID NO: 43202 - DNA, 16 bp, Artificial Sequence
  synthetic [barcode part1]
gaattactgccggact

SEQ ID NO: 43203 - DNA, 16 bp, Artificial Sequence
  synthetic [barcode part1]
aattggccggtattgc

SEQ ID NO: 43204 - DNA, 16 bp, Artificial Sequence
  synthetic [barcode part1]
tcgttgagagatacag

SEQ ID NO: 43205 - DNA, 16 bp, Artificial Sequence
  synthetic [barcode part1]
tgatagataagtgccg

SEQ ID NO: 43206 - DNA, 16 bp, Artificial Sequence
  synthetic [barcode part1]
gtggttactaactctc

SEQ ID NO: 43207 - DNA, 16 bp, Artificial Sequence
  synthetic [barcode part1]
tactagacttgcgtct

SEQ ID NO: 43208 - DNA, 16 bp, Artificial Sequence
  synthetic [barcode part1]
gattgtccggaggtag

SEQ ID NO: 43209 - DNA, 16 bp, Artificial Sequence
  synthetic [barcode part1]
aacagtagacgagacg

SEQ ID NO: 43210 - DNA, 16 bp, Artificial Sequence
  synthetic [barcode part1]
agtaacactacgaacg

SEQ ID NO: 43211 - DNA, 16 bp, Artificial Sequence
  synthetic [barcode part1]
tccaattcgcgaccac

SEQ ID NO: 43212 - DNA, 16 bp, Artificial Sequence
  synthetic [barcode part1]
tcaacacgtcacacag

SEQ ID NO: 43213 - DNA, 16 bp, Artificial Sequence
  synthetic [barcode part1]
acagtactcgaagtcc

SEQ ID NO: 43214 - DNA, 16 bp, Artificial Sequence
  synthetic [barcode part1]
cgttgtcgttcggatc

SEQ ID NO: 43215 - DNA, 16 bp, Artificial Sequence
  synthetic [barcode part1]
acgcaatctctccgac

SEQ ID NO: 43216 - DNA, 16 bp, Artificial Sequence
  synthetic [barcode part1]
ttggtctacctggatt

SEQ ID NO: 43217 - DNA, 16 bp, Artificial Sequence
  synthetic [barcode part1]
acagttacacgcgact

SEQ ID NO: 43218 - DNA, 16 bp, Artificial Sequence
  synthetic [barcode part1]
cgaattgcgtgaaggc

SEQ ID NO: 43219 - DNA, 16 bp, Artificial Sequence
  synthetic [barcode part1]
gactcgcaggtagtag

SEQ ID NO: 43220 - DNA, 16 bp, Artificial Sequence
  synthetic [barcode part1]
actcgtcagacgaatc

SEQ ID NO: 43221 - DNA, 16 bp, Artificial Sequence
  synthetic [barcode part1]
gtcggtagaaccaggt

SEQ ID NO: 43222 - DNA, 16 bp, Artificial Sequence
  synthetic [barcode part1]
accaacttctcaggag

SEQ ID NO: 43223 - DNA, 16 bp, Artificial Sequence
  synthetic [barcode part1]
aactgtaggtcaaggt

SEQ ID NO: 43224 - DNA, 16 bp, Artificial Sequence
  synthetic [barcode part1]
acctgagtctatcact

SEQ ID NO: 43225 - DNA, 16 bp, Artificial Sequence
  synthetic [barcode part1]
tgtaggcacggattct

SEQ ID NO: 43226 - DNA, 16 bp, Artificial Sequence
  synthetic [barcode part1]
ttgtggtggccttaag

SEQ ID NO: 43227 - DNA, 16 bp, Artificial Sequence
  synthetic [barcode part1]
tcgactatagtcgacg

SEQ ID NO: 43228 - DNA, 16 bp, Artificial Sequence
  synthetic [barcode part1]
tcaaccttcgtgtagt

SEQ ID NO: 43229 - DNA, 16 bp, Artificial Sequence
  synthetic [barcode part1]
aacgaagaatccgtgt

SEQ ID NO: 43230 - DNA, 16 bp, Artificial Sequence
  synthetic [barcode part1]
tcgtggaataagacgt

SEQ ID NO: 43231 - DNA, 16 bp, Artificial Sequence
  synthetic [barcode part1]
ttgtggaataaggcac

SEQ ID NO: 43232 - DNA, 16 bp, Artificial Sequence
  synthetic [barcode part1]
agatctctcggttgag

SEQ ID NO: 43233 - DNA, 16 bp, Artificial Sequence
  synthetic [barcode part1]
aaggtggacctacgac

SEQ ID NO: 43234 - DNA, 16 bp, Artificial Sequence
  synthetic [barcode part1]
aaccgcagaagtcggt

SEQ ID NO: 43235 - DNA, 16 bp, Artificial Sequence
  synthetic [barcode part1]
tccacgtgttggactc

SEQ ID NO: 43236 - DNA, 16 bp, Artificial Sequence
  synthetic [barcode part1]
cgtggcgaatactact

SEQ ID NO: 43237 - DNA, 16 bp, Artificial Sequence
  synthetic [barcode part1]
tcaggtggaataacgt

SEQ ID NO: 43238 - DNA, 16 bp, Artificial Sequence
  synthetic [barcode part1]
gtgcgtagactagtct

SEQ ID NO: 43239 - DNA, 16 bp, Artificial Sequence
  synthetic [barcode part1]
aggcctaacaaccgtt

SEQ ID NO: 43240 - DNA, 16 bp, Artificial Sequence
  synthetic [barcode part1]
tggtatacggcggagt

SEQ ID NO: 43241 - DNA, 16 bp, Artificial Sequence
  synthetic [barcode part1]
tgtgatcgttgaagag

SEQ ID NO: 43242 - DNA, 16 bp, Artificial Sequence
  synthetic [barcode part1]
tataggcctacttcac

SEQ ID NO: 43243 - DNA, 16 bp, Artificial Sequence
  synthetic [barcode part1]
acgactgatcgacact

SEQ ID NO: 43244 - DNA, 16 bp, Artificial Sequence
  synthetic [barcode part1]
actgtggtattcacct

SEQ ID NO: 43245 - DNA, 16 bp, Artificial Sequence
  synthetic [barcode part1]
cacggtactatctgtt

SEQ ID NO: 43246 - DNA, 16 bp, Artificial Sequence
  synthetic [barcode part1]
caacaggcactcgaag

SEQ ID NO: 43247 - DNA, 16 bp, Artificial Sequence
  synthetic [barcode part1]
gtctaactacagagag

SEQ ID NO: 43248 - DNA, 16 bp, Artificial Sequence
  synthetic [barcode part1]
aacgactgcgcagaac

SEQ ID NO: 43249 - DNA, 16 bp, Artificial Sequence
  synthetic [barcode part1]
cacactagagaagttg

SEQ ID NO: 43250 - DNA, 16 bp, Artificial Sequence
  synthetic [barcode part1]
gtagttctgtcagacg

SEQ ID NO: 43251 - DNA, 16 bp, Artificial Sequence
  synthetic [barcode part1]
aattaggcctgacctg

SEQ ID NO: 43252 - DNA, 16 bp, Artificial Sequence
  synthetic [barcode part1]
atacgacgcacgttac

SEQ ID NO: 43253 - DNA, 16 bp, Artificial Sequence
  synthetic [barcode part1]
gtgttacttgttcacg

SEQ ID NO: 43254 - DNA, 16 bp, Artificial Sequence
  synthetic [barcode part1]
aggcaggtattcacct

SEQ ID NO: 43255 - DNA, 16 bp, Artificial Sequence
  synthetic [barcode part1]
caatcgtcgttccacg

SEQ ID NO: 43256 - DNA, 16 bp, Artificial Sequence
  synthetic [barcode part1]
aaggcgtaaggatacg

SEQ ID NO: 43257 - DNA, 16 bp, Artificial Sequence
  synthetic [barcode part1]
aactgtatctcggtct

SEQ ID NO: 43258 - DNA, 16 bp, Artificial Sequence
  synthetic [barcode part1]
gagttggacactggtg

SEQ ID NO: 43259 - DNA, 16 bp, Artificial Sequence
  synthetic [barcode part1]
tcaggtgacaagtcct

SEQ ID NO: 43260 - DNA, 16 bp, Artificial Sequence
  synthetic [barcode part1]
tacactccacttccgt

SEQ ID NO: 43261 - DNA, 16 bp, Artificial Sequence
  synthetic [barcode part1]
gcacagtgtgtcaact

SEQ ID NO: 43262 - DNA, 16 bp, Artificial Sequence
  synthetic [barcode part1]
actcgattggtagtcg

SEQ ID NO: 43263 - DNA, 16 bp, Artificial Sequence
  synthetic [barcode part1]
tgcagtgatctactct

SEQ ID NO: 43264 - DNA, 16 bp, Artificial Sequence
  synthetic [barcode part1]
gaagtagacgagttct

SEQ ID NO: 43265 - DNA, 16 bp, Artificial Sequence
  synthetic [barcode part1]
accggatcttacactt

SEQ ID NO: 43266 - DNA, 16 bp, Artificial Sequence
  synthetic [barcode part1]
cctgtcgtaacaaggt

SEQ ID NO: 43267 - DNA, 16 bp, Artificial Sequence
  synthetic [barcode part1]
cctctggaccgatact

SEQ ID NO: 43268 - DNA, 16 bp, Artificial Sequence
  synthetic [barcode part1]
atcgcggagtggatac

SEQ ID NO: 43269 - DNA, 16 bp, Artificial Sequence
  synthetic [barcode part1]
aatcggtactacgacc

SEQ ID NO: 43270 - DNA, 16 bp, Artificial Sequence
  synthetic [barcode part1]
tcacttgccgcaacgt

SEQ ID NO: 43271 - DNA, 16 bp, Artificial Sequence
  synthetic [barcode part1]
tgcacttccgtatcct

SEQ ID NO: 43272 - DNA, 16 bp, Artificial Sequence
  synthetic [barcode part1]
tgcgtatcaattggcg

SEQ ID NO: 43273 - DNA, 16 bp, Artificial Sequence
  synthetic [barcode part1]
gcctatcacttgttcc

SEQ ID NO: 43274 - DNA, 16 bp, Artificial Sequence
  synthetic [barcode part1]
tgaagtccagttgacc

SEQ ID NO: 43275 - DNA, 16 bp, Artificial Sequence
  synthetic [barcode part1]
gttattccaccactcc

SEQ ID NO: 43276 - DNA, 16 bp, Artificial Sequence
  synthetic [barcode part1]
tgagagatcctctggt

SEQ ID NO: 43277 - DNA, 16 bp, Artificial Sequence
  synthetic [barcode part1]
tcctacagtgcagagt

SEQ ID NO: 43278 - DNA, 16 bp, Artificial Sequence
  synthetic [barcode part1]
gactggcagttagttc

SEQ ID NO: 43279 - DNA, 16 bp, Artificial Sequence
  synthetic [barcode part1]
acctctgtaagaacgc

SEQ ID NO: 43280 - DNA, 16 bp, Artificial Sequence
  synthetic [barcode part1]
gcggagaatacagagt

SEQ ID NO: 43281 - DNA, 16 bp, Artificial Sequence
  synthetic [barcode part1]
tagtggtggagtacgc

SEQ ID NO: 43282 - DNA, 16 bp, Artificial Sequence
  synthetic [barcode part1]
aagtcgttctgtactc

SEQ ID NO: 43283 - DNA, 16 bp, Artificial Sequence
  synthetic [barcode part1]
caggtcagatcgttgt

SEQ ID NO: 43284 - DNA, 16 bp, Artificial Sequence
  synthetic [barcode part1]
tatatccgttcaacgc

SEQ ID NO: 43285 - DNA, 16 bp, Artificial Sequence
  synthetic [barcode part1]
tacaggtgaactcacc

SEQ ID NO: 43286 - DNA, 16 bp, Artificial Sequence
  synthetic [barcode part1]
gtacggtaactctctt

SEQ ID NO: 43287 - DNA, 16 bp, Artificial Sequence
  synthetic [barcode part1]
ttcggcgtggaagtag

SEQ ID NO: 43288 - DNA, 16 bp, Artificial Sequence
  synthetic [barcode part1]
aggatctagacagatc

SEQ ID NO: 43289 - DNA, 16 bp, Artificial Sequence
  synthetic [barcode part1]
atacggttacaaccgc

SEQ ID NO: 43290 - DNA, 16 bp, Artificial Sequence
  synthetic [barcode part1]
gcacttcggtccaatc

SEQ ID NO: 43291 - DNA, 16 bp, Artificial Sequence
  synthetic [barcode part1]
acgaacgacgacactg

SEQ ID NO: 43292 - DNA, 16 bp, Artificial Sequence
  synthetic [barcode part1]
tcgtcgttagagtgac

SEQ ID NO: 43293 - DNA, 16 bp, Artificial Sequence
  synthetic [barcode part1]
tatactccactgaacc

SEQ ID NO: 43294 - DNA, 16 bp, Artificial Sequence
  synthetic [barcode part1]
tgcctcttgatagttg

SEQ ID NO: 43295 - DNA, 16 bp, Artificial Sequence
  synthetic [barcode part1]
atctccacttgcacct

SEQ ID NO: 43296 - DNA, 16 bp, Artificial Sequence
  synthetic [barcode part1]
aggagataggccaagt

SEQ ID NO: 43297 - DNA, 16 bp, Artificial Sequence
  synthetic [barcode part1]
tggttcctgattgtac

SEQ ID NO: 43298 - DNA, 16 bp, Artificial Sequence
  synthetic [barcode part1]
tcttcaggtactgact

SEQ ID NO: 43299 - DNA, 16 bp, Artificial Sequence
  synthetic [barcode part1]
tcggtagtgccaagtt

SEQ ID NO: 43300 - DNA, 16 bp, Artificial Sequence
  synthetic [barcode part1]
gcaccttagagtgtac

SEQ ID NO: 43301 - DNA, 16 bp, Artificial Sequence
  synthetic [barcode part1]
atacctcgtcaccggt

SEQ ID NO: 43302 - DNA, 16 bp, Artificial Sequence
  synthetic [barcode part1]
tgaaggaccgagaagt

SEQ ID NO: 43303 - DNA, 16 bp, Artificial Sequence
  synthetic [barcode part1]
cacgttcgaattactc

SEQ ID NO: 43304 - DNA, 16 bp, Artificial Sequence
  synthetic [barcode part1]
caccaagattcctact

SEQ ID NO: 43305 - DNA, 16 bp, Artificial Sequence
  synthetic [barcode part1]
tcaggtataggacaac

SEQ ID NO: 43306 - DNA, 16 bp, Artificial Sequence
  synthetic [barcode part1]
gtcgttcggacctatc

SEQ ID NO: 43307 - DNA, 16 bp, Artificial Sequence
  synthetic [barcode part1]
tcagttgaccacagtg

SEQ ID NO: 43308 - DNA, 16 bp, Artificial Sequence
  synthetic [barcode part1]
aaccagtgtgtacacc

SEQ ID NO: 43309 - DNA, 16 bp, Artificial Sequence
  synthetic [barcode part1]
caggtcaattaggcct

SEQ ID NO: 43310 - DNA, 16 bp, Artificial Sequence
  synthetic [barcode part1]
tcctgaagtggtgttg

SEQ ID NO: 43311 - DNA, 16 bp, Artificial Sequence
  synthetic [barcode part1]
ttgatctaacgtgtcc

SEQ ID NO: 43312 - DNA, 16 bp, Artificial Sequence
  synthetic [barcode part1]
tgccttccggtaactg

SEQ ID NO: 43313 - DNA, 16 bp, Artificial Sequence
  synthetic [barcode part1]
cgtctaccgagattcc

SEQ ID NO: 43314 - DNA, 16 bp, Artificial Sequence
  synthetic [barcode part1]
agttgacgttggttgc

SEQ ID NO: 43315 - DNA, 16 bp, Artificial Sequence
  synthetic [barcode part1]
cgtgttagtcgtacag

SEQ ID NO: 43316 - DNA, 16 bp, Artificial Sequence
  synthetic [barcode part1]
gtacctatctgccacg

SEQ ID NO: 43317 - DNA, 16 bp, Artificial Sequence
  synthetic [barcode part1]
tattgtcacctcctgc

SEQ ID NO: 43318 - DNA, 16 bp, Artificial Sequence
  synthetic [barcode part1]
gcggttaattgcgtgt

SEQ ID NO: 43319 - DNA, 16 bp, Artificial Sequence
  synthetic [barcode part1]
cggccttcttcttagt

SEQ ID NO: 43320 - DNA, 16 bp, Artificial Sequence
  synthetic [barcode part1]
atacggcctgagaggt

SEQ ID NO: 43321 - DNA, 16 bp, Artificial Sequence
  synthetic [barcode part1]
tattggagacacgagt

SEQ ID NO: 43322 - DNA, 16 bp, Artificial Sequence
  synthetic [barcode part1]
cggactatcggtaact

SEQ ID NO: 43323 - DNA, 16 bp, Artificial Sequence
  synthetic [barcode part1]
gattctcttgacacgt

SEQ ID NO: 43324 - DNA, 16 bp, Artificial Sequence
  synthetic [barcode part1]
gtgtgactcaggaggt

SEQ ID NO: 43325 - DNA, 16 bp, Artificial Sequence
  synthetic [barcode part1]
tacttctctcctgcag

SEQ ID NO: 43326 - DNA, 16 bp, Artificial Sequence
  synthetic [barcode part1]
cgaactagtgcggaac

SEQ ID NO: 43327 - DNA, 16 bp, Artificial Sequence
  synthetic [barcode part1]
ttccaagttcactcag

SEQ ID NO: 43328 - DNA, 16 bp, Artificial Sequence
  synthetic [barcode part1]
cgtgtctgatataggc

SEQ ID NO: 43329 - DNA, 16 bp, Artificial Sequence
  synthetic [barcode part1]
tacgtctactcggcgt

SEQ ID NO: 43330 - DNA, 16 bp, Artificial Sequence
  synthetic [barcode part1]
ttggatctatacctcg

SEQ ID NO: 43331 - DNA, 16 bp, Artificial Sequence
  synthetic [barcode part1]
gcctatcttacaacac

SEQ ID NO: 43332 - DNA, 16 bp, Artificial Sequence
  synthetic [barcode part1]
ttactctgtgcgattg

SEQ ID NO: 43333 - DNA, 16 bp, Artificial Sequence
  synthetic [barcode part1]
agacctggaacgttct

SEQ ID NO: 43334 - DNA, 16 bp, Artificial Sequence
  synthetic [barcode part1]
gattgcacctcgactc

SEQ ID NO: 43335 - DNA, 16 bp, Artificial Sequence
  synthetic [barcode part1]
cgcgatcacacttaag

SEQ ID NO: 43336 - DNA, 16 bp, Artificial Sequence
  synthetic [barcode part1]
gttagtcgtacgtacg

SEQ ID NO: 43337 - DNA, 16 bp, Artificial Sequence
  synthetic [barcode part1]
gaacttgtcgttgttc

SEQ ID NO: 43338 - DNA, 16 bp, Artificial Sequence
  synthetic [barcode part1]
gtcaggataacgcacg

SEQ ID NO: 43339 - DNA, 16 bp, Artificial Sequence
  synthetic [barcode part1]
tatccgcgcgaataac

SEQ ID NO: 43340 - DNA, 16 bp, Artificial Sequence
  synthetic [barcode part1]
cctgaccaaggttagt

SEQ ID NO: 43341 - DNA, 16 bp, Artificial Sequence
  synthetic [barcode part1]
tcgagtaaggcaacgc

SEQ ID NO: 43342 - DNA, 16 bp, Artificial Sequence
  synthetic [barcode part1]
gcgagtacgagatctg

SEQ ID NO: 43343 - DNA, 16 bp, Artificial Sequence
  synthetic [barcode part1]
agaggtacttaacggt

SEQ ID NO: 43344 - DNA, 16 bp, Artificial Sequence
  synthetic [barcode part1]
cgtaacgtggaatcct

SEQ ID NO: 43345 - DNA, 16 bp, Artificial Sequence
  synthetic [barcode part1]
ccgtagaggtggtagt

SEQ ID NO: 43346 - DNA, 16 bp, Artificial Sequence
  synthetic [barcode part1]
tgtacaccgcgtatag

SEQ ID NO: 43347 - DNA, 16 bp, Artificial Sequence
  synthetic [barcode part1]
cactggcgagagattg

SEQ ID NO: 43348 - DNA, 16 bp, Artificial Sequence
  synthetic [barcode part1]
ttgataacgaaccgcc

SEQ ID NO: 43349 - DNA, 16 bp, Artificial Sequence
  synthetic [barcode part1]
gtccggttgtaggaag

SEQ ID NO: 43350 - DNA, 16 bp, Artificial Sequence
  synthetic [barcode part1]
acactctgcgtgaagt

SEQ ID NO: 43351 - DNA, 16 bp, Artificial Sequence
  synthetic [barcode part1]
caaccgaaggatcctt

SEQ ID NO: 43352 - DNA, 16 bp, Artificial Sequence
  synthetic [barcode part1]
agttacgatcgacacc

SEQ ID NO: 43353 - DNA, 16 bp, Artificial Sequence
  synthetic [barcode part1]
tgtacctcggattact

SEQ ID NO: 43354 - DNA, 16 bp, Artificial Sequence
  synthetic [barcode part1]
atcgtgattacggtgc

SEQ ID NO: 43355 - DNA, 16 bp, Artificial Sequence
  synthetic [barcode part1]
agagttctcgtgacac

SEQ ID NO: 43356 - DNA, 16 bp, Artificial Sequence
  synthetic [barcode part1]
taggtacaccacctcc

SEQ ID NO: 43357 - DNA, 16 bp, Artificial Sequence
  synthetic [barcode part1]
gttctcagtggagact

SEQ ID NO: 43358 - DNA, 16 bp, Artificial Sequence
  synthetic [barcode part1]
tctgtgcctaatagtc

SEQ ID NO: 43359 - DNA, 16 bp, Artificial Sequence
  synthetic [barcode part1]
cactggccaatatacg

SEQ ID NO: 43360 - DNA, 16 bp, Artificial Sequence
  synthetic [barcode part1]
tgcagacggtaggact

SEQ ID NO: 43361 - DNA, 16 bp, Artificial Sequence
  synthetic [barcode part1]
aacagagttccaccgt

SEQ ID NO: 43362 - DNA, 16 bp, Artificial Sequence
  synthetic [barcode part1]
gcggacctcctcaatt

SEQ ID NO: 43363 - DNA, 16 bp, Artificial Sequence
  synthetic [barcode part1]
tgaggttatcggtcac

SEQ ID NO: 43364 - DNA, 16 bp, Artificial Sequence
  synthetic [barcode part1]
ccttggccttctaact

SEQ ID NO: 43365 - DNA, 16 bp, Artificial Sequence
  synthetic [barcode part1]
tcaggcacttgccact

SEQ ID NO: 43366 - DNA, 16 bp, Artificial Sequence
  synthetic [barcode part1]
ttcagtgtggaggcag

SEQ ID NO: 43367 - DNA, 16 bp, Artificial Sequence
  synthetic [barcode part1]
gactgtgtcagttctt

SEQ ID NO: 43368 - DNA, 16 bp, Artificial Sequence
  synthetic [barcode part1]
aggtacttactgttcc

SEQ ID NO: 43369 - DNA, 16 bp, Artificial Sequence
  synthetic [barcode part1]
atcacagtgttcactc

SEQ ID NO: 43370 - DNA, 16 bp, Artificial Sequence
  synthetic [barcode part1]
agtacacgtcagtacc

SEQ ID NO: 43371 - DNA, 16 bp, Artificial Sequence
  synthetic [barcode part1]
acttcgatcgaagtcg

SEQ ID NO: 43372 - DNA, 16 bp, Artificial Sequence
  synthetic [barcode part1]
aacagttccgagtcgt

SEQ ID NO: 43373 - DNA, 16 bp, Artificial Sequence
  synthetic [barcode part1]
tatcttcgcaccttcg

SEQ ID NO: 43374 - DNA, 16 bp, Artificial Sequence
  synthetic [barcode part1]
gcgaagactaggtcac

SEQ ID NO: 43375 - DNA, 16 bp, Artificial Sequence
  synthetic [barcode part1]
gtaatcgtcagagaac

SEQ ID NO: 43376 - DNA, 16 bp, Artificial Sequence
  synthetic [barcode part1]
atccgatagtcgtcag

SEQ ID NO: 43377 - DNA, 16 bp, Artificial Sequence
  synthetic [barcode part1]
acgtacaagttccgac

SEQ ID NO: 43378 - DNA, 16 bp, Artificial Sequence
  synthetic [barcode part1]
cagtctattcacgttg

SEQ ID NO: 43379 - DNA, 16 bp, Artificial Sequence
  synthetic [barcode part1]
ccgaatatccgagtac

SEQ ID NO: 43380 - DNA, 16 bp, Artificial Sequence
  synthetic [barcode part1]
agtgattggaacgtgt

SEQ ID NO: 43381 - DNA, 16 bp, Artificial Sequence
  synthetic [barcode part1]
gaccgaattgtgcgag

SEQ ID NO: 43382 - DNA, 16 bp, Artificial Sequence
  synthetic [barcode part1]
ccaggtaatcttgtct

SEQ ID NO: 43383 - DNA, 16 bp, Artificial Sequence
  synthetic [barcode part1]
gcgccagattgagagt

SEQ ID NO: 43384 - DNA, 16 bp, Artificial Sequence
  synthetic [barcode part1]
tgccacttagactcgc

SEQ ID NO: 43385 - DNA, 16 bp, Artificial Sequence
  synthetic [barcode part1]
gagacgatccgaacac

SEQ ID NO: 43386 - DNA, 16 bp, Artificial Sequence
  synthetic [barcode part1]
cgacgatctccacact

SEQ ID NO: 43387 - DNA, 16 bp, Artificial Sequence
  synthetic [barcode part1]
aaggattatcagtgcg

SEQ ID NO: 43388 - DNA, 16 bp, Artificial Sequence
  synthetic [barcode part1]
gatcacgtaaccgtgt

SEQ ID NO: 43389 - DNA, 16 bp, Artificial Sequence
  synthetic [barcode part1]
gactagtgattggtcc

SEQ ID NO: 43390 - DNA, 16 bp, Artificial Sequence
  synthetic [barcode part1]
gattcgactagaccac

SEQ ID NO: 43391 - DNA, 16 bp, Artificial Sequence
  synthetic [barcode part1]
agaaccgtacaagttg

SEQ ID NO: 43392 - DNA, 16 bp, Artificial Sequence
  synthetic [barcode part1]
aatagtgtcgcggacg

SEQ ID NO: 43393 - DNA, 16 bp, Artificial Sequence
  synthetic [barcode part1]
gacaatccggtgattc

SEQ ID NO: 43394 - DNA, 16 bp, Artificial Sequence
  synthetic [barcode part1]
cagtcaggactgactt

SEQ ID NO: 43395 - DNA, 16 bp, Artificial Sequence
  synthetic [barcode part1]
tatccgaacgcaactg

SEQ ID NO: 43396 - DNA, 16 bp, Artificial Sequence
  synthetic [barcode part1]
cctcgatagtccacac

SEQ ID NO: 43397 - DNA, 16 bp, Artificial Sequence
  synthetic [barcode part1]
gttctgacgtaacacg

SEQ ID NO: 43398 - DNA, 16 bp, Artificial Sequence
  synthetic [barcode part1]
tatcgcctgtcaatac

SEQ ID NO: 43399 - DNA, 16 bp, Artificial Sequence
  synthetic [barcode part1]
tagagaacacagttgc

SEQ ID NO: 43400 - DNA, 16 bp, Artificial Sequence
  synthetic [barcode part1]
ccttacggtacttctc

SEQ ID NO: 43401 - DNA, 16 bp, Artificial Sequence
  synthetic [barcode part1]
gcacaacctgagaggt

SEQ ID NO: 43402 - DNA, 16 bp, Artificial Sequence
  synthetic [barcode part1]
tgaagtcgatctcgac

SEQ ID NO: 43403 - DNA, 16 bp, Artificial Sequence
  synthetic [barcode part1]
actagtgagaccggac

SEQ ID NO: 43404 - DNA, 16 bp, Artificial Sequence
  synthetic [barcode part1]
atcaccactccgtgtg

SEQ ID NO: 43405 - DNA, 16 bp, Artificial Sequence
  synthetic [barcode part1]
cgaaggaactatacac

SEQ ID NO: 43406 - DNA, 16 bp, Artificial Sequence
  synthetic [barcode part1]
gttatcgaagaacacg

SEQ ID NO: 43407 - DNA, 16 bp, Artificial Sequence
  synthetic [barcode part1]
cgaggattggactacg

SEQ ID NO: 43408 - DNA, 16 bp, Artificial Sequence
  synthetic [barcode part1]
agagtctggcaagtgc

SEQ ID NO: 43409 - DNA, 16 bp, Artificial Sequence
  synthetic [barcode part1]
gattcagtcgacagtc

SEQ ID NO: 43410 - DNA, 16 bp, Artificial Sequence
  synthetic [barcode part1]
gttatctcaagtgtcc

SEQ ID NO: 43411 - DNA, 16 bp, Artificial Sequence
  synthetic [barcode part1]
actacgaccgtaacac

SEQ ID NO: 43412 - DNA, 16 bp, Artificial Sequence
  synthetic [barcode part1]
caaggacacaacttag

SEQ ID NO: 43413 - DNA, 16 bp, Artificial Sequence
  synthetic [barcode part1]
gacaaccaccagactt

SEQ ID NO: 43414 - DNA, 16 bp, Artificial Sequence
  synthetic [barcode part1]
tgcctgttcgtctatc

SEQ ID NO: 43415 - DNA, 16 bp, Artificial Sequence
  synthetic [barcode part1]
actggccagaatcttg

SEQ ID NO: 43416 - DNA, 16 bp, Artificial Sequence
  synthetic [barcode part1]
ttgagtgtctaccgcc

SEQ ID NO: 43417 - DNA, 16 bp, Artificial Sequence
  synthetic [barcode part1]
gtcggtgatagttacc

SEQ ID NO: 43418 - DNA, 16 bp, Artificial Sequence
  synthetic [barcode part1]
gcgtacgtatatacgc

SEQ ID NO: 43419 - DNA, 16 bp, Artificial Sequence
  synthetic [barcode part1]
ttaattctcgccgcct

SEQ ID NO: 43420 - DNA, 16 bp, Artificial Sequence
  synthetic [barcode part1]
agtcctatagacagag

SEQ ID NO: 43421 - DNA, 16 bp, Artificial Sequence
  synthetic [barcode part1]
tcagacaccactctgc

SEQ ID NO: 43422 - DNA, 16 bp, Artificial Sequence
  synthetic [barcode part1]
gtgaccgttccagttc

SEQ ID NO: 43423 - DNA, 16 bp, Artificial Sequence
  synthetic [barcode part1]
aagaagttgtcagtgc

SEQ ID NO: 43424 - DNA, 16 bp, Artificial Sequence
  synthetic [barcode part1]
cggaattaattccggc

SEQ ID NO: 43425 - DNA, 16 bp, Artificial Sequence
  synthetic [barcode part1]
tgttctataggacggc

SEQ ID NO: 43426 - DNA, 16 bp, Artificial Sequence
  synthetic [barcode part1]
agtaacactgtagacg

SEQ ID NO: 43427 - DNA, 16 bp, Artificial Sequence
  synthetic [barcode part1]
aggacgagagttcacc

SEQ ID NO: 43428 - DNA, 16 bp, Artificial Sequence
  synthetic [barcode part1]
tcacaacgtaccacag

SEQ ID NO: 43429 - DNA, 16 bp, Artificial Sequence
  synthetic [barcode part1]
tgccaattagtcgcag

SEQ ID NO: 43430 - DNA, 16 bp, Artificial Sequence
  synthetic [barcode part1]
gtctcaaccagagttg

SEQ ID NO: 43431 - DNA, 16 bp, Artificial Sequence
  synthetic [barcode part1]
tagatcgttctcgcgc

SEQ ID NO: 43432 - DNA, 16 bp, Artificial Sequence
  synthetic [barcode part1]
tgatagtggtccgact

SEQ ID NO: 43433 - DNA, 16 bp, Artificial Sequence
  synthetic [barcode part1]
cgtagtaggtgaacgc

SEQ ID NO: 43434 - DNA, 16 bp, Artificial Sequence
  synthetic [barcode part1]
ttcttcacgtcagtag

SEQ ID NO: 43435 - DNA, 16 bp, Artificial Sequence
  synthetic [barcode part1]
gatacacagtcagaac

SEQ ID NO: 43436 - DNA, 16 bp, Artificial Sequence
  synthetic [barcode part1]
ttcgacctagtatacc

SEQ ID NO: 43437 - DNA, 16 bp, Artificial Sequence
  synthetic [barcode part1]
agtatatcgcgtgacc

SEQ ID NO: 43438 - DNA, 16 bp, Artificial Sequence
  synthetic [barcode part1]
aactgtactcttcggt

SEQ ID NO: 43439 - DNA, 16 bp, Artificial Sequence
  synthetic [barcode part1]
tcgagactctatctgt

SEQ ID NO: 43440 - DNA, 16 bp, Artificial Sequence
  synthetic [barcode part1]
cgaaccacagtgactt

SEQ ID NO: 43441 - DNA, 16 bp, Artificial Sequence
  synthetic [barcode part1]
tcacactgacgattct

SEQ ID NO: 43442 - DNA, 16 bp, Artificial Sequence
  synthetic [barcode part1]
cgttcaagttacttcg

SEQ ID NO: 43443 - DNA, 16 bp, Artificial Sequence
  synthetic [barcode part1]
cagatcacttcgcacc

SEQ ID NO: 43444 - DNA, 16 bp, Artificial Sequence
  synthetic [barcode part1]
acaggttcacagactc

SEQ ID NO: 43445 - DNA, 16 bp, Artificial Sequence
  synthetic [barcode part1]
ccgtcttacgtggttg

SEQ ID NO: 43446 - DNA, 16 bp, Artificial Sequence
  synthetic [barcode part1]
cacttcaagactcgtt

SEQ ID NO: 43447 - DNA, 16 bp, Artificial Sequence
  synthetic [barcode part1]
tacacaccaacaccag

SEQ ID NO: 43448 - DNA, 16 bp, Artificial Sequence
  synthetic [barcode part1]
actgtactcttaccag

SEQ ID NO: 43449 - DNA, 16 bp, Artificial Sequence
  synthetic [barcode part1]
cacttgtgtgagtggt

SEQ ID NO: 43450 - DNA, 16 bp, Artificial Sequence
  synthetic [barcode part1]
ataaccgactagtgcc

SEQ ID NO: 43451 - DNA, 16 bp, Artificial Sequence
  synthetic [barcode part1]
gccgtcaagaagtacg

SEQ ID NO: 43452 - DNA, 16 bp, Artificial Sequence
  synthetic [barcode part1]
tgttgcctccgtagac

SEQ ID NO: 43453 - DNA, 16 bp, Artificial Sequence
  synthetic [barcode part1]
acctgcgactaggaag

SEQ ID NO: 43454 - DNA, 16 bp, Artificial Sequence
  synthetic [barcode part1]
tccaacctaatacgtc

SEQ ID NO: 43455 - DNA, 16 bp, Artificial Sequence
  synthetic [barcode part1]
gtccaatcgacaactg

SEQ ID NO: 43456 - DNA, 16 bp, Artificial Sequence
  synthetic [barcode part1]
acgttctgttgccggt

SEQ ID NO: 43457 - DNA, 16 bp, Artificial Sequence
  synthetic [barcode part1]
atcggtaggattagac

SEQ ID NO: 43458 - DNA, 16 bp, Artificial Sequence
  synthetic [barcode part1]
tagttggaccacaacc

SEQ ID NO: 43459 - DNA, 16 bp, Artificial Sequence
  synthetic [barcode part1]
aaggccttgaggtctt

SEQ ID NO: 43460 - DNA, 16 bp, Artificial Sequence
  synthetic [barcode part1]
gtccacgtcctatcag

SEQ ID NO: 43461 - DNA, 16 bp, Artificial Sequence
  synthetic [barcode part1]
aatcacctgagtcgtg

SEQ ID NO: 43462 - DNA, 16 bp, Artificial Sequence
  synthetic [barcode part1]
gtgtgatcaatcgtgc

SEQ ID NO: 43463 - DNA, 16 bp, Artificial Sequence
  synthetic [barcode part1]
ttctcgcctattagag

SEQ ID NO: 43464 - DNA, 16 bp, Artificial Sequence
  synthetic [barcode part1]
acaacgtacacgtgtc

SEQ ID NO: 43465 - DNA, 16 bp, Artificial Sequence
  synthetic [barcode part1]
tactacttggaggacc

SEQ ID NO: 43466 - DNA, 16 bp, Artificial Sequence
  synthetic [barcode part1]
tgcacttctcgcactt

SEQ ID NO: 43467 - DNA, 16 bp, Artificial Sequence
  synthetic [barcode part1]
tctcgacttgaatacc

SEQ ID NO: 43468 - DNA, 16 bp, Artificial Sequence
  synthetic [barcode part1]
gactgcagtcaacgtt

SEQ ID NO: 43469 - DNA, 16 bp, Artificial Sequence
  synthetic [barcode part1]
tcgaacagaatccgtc

SEQ ID NO: 43470 - DNA, 16 bp, Artificial Sequence
  synthetic [barcode part1]
gttgcggataacgttc

SEQ ID NO: 43471 - DNA, 16 bp, Artificial Sequence
  synthetic [barcode part1]
acacctatcgtcttag

SEQ ID NO: 43472 - DNA, 16 bp, Artificial Sequence
  synthetic [barcode part1]
accactctcacttcac

SEQ ID NO: 43473 - DNA, 16 bp, Artificial Sequence
  synthetic [barcode part1]
gactactacttggcag

SEQ ID NO: 43474 - DNA, 16 bp, Artificial Sequence
  synthetic [barcode part1]
gttcgccgtcttaggt

SEQ ID NO: 43475 - DNA, 16 bp, Artificial Sequence
  synthetic [barcode part1]
tgacgcgttggtatac

SEQ ID NO: 43476 - DNA, 16 bp, Artificial Sequence
  synthetic [barcode part1]
aattctataggcggag

SEQ ID NO: 43477 - DNA, 16 bp, Artificial Sequence
  synthetic [barcode part1]
atcgcaacagacggac

SEQ ID NO: 43478 - DNA, 16 bp, Artificial Sequence
  synthetic [barcode part1]
cacgcgtgattaactg

SEQ ID NO: 43479 - DNA, 16 bp, Artificial Sequence
  synthetic [barcode part1]
ttgactcgttcggatt

SEQ ID NO: 43480 - DNA, 16 bp, Artificial Sequence
  synthetic [barcode part1]
cacggcgcagataagt

SEQ ID NO: 43481 - DNA, 16 bp, Artificial Sequence
  synthetic [barcode part1]
gttagtcgacttcgag

SEQ ID NO: 43482 - DNA, 16 bp, Artificial Sequence
  synthetic [barcode part1]
acaagtcgttgaagac

SEQ ID NO: 43483 - DNA, 16 bp, Artificial Sequence
  synthetic [barcode part1]
ttgcaactggtaccag

SEQ ID NO: 43484 - DNA, 16 bp, Artificial Sequence
  synthetic [barcode part1]
tatcggacaggaacgc

SEQ ID NO: 43485 - DNA, 16 bp, Artificial Sequence
  synthetic [barcode part1]
aggatatcctcgtgtg

SEQ ID NO: 43486 - DNA, 16 bp, Artificial Sequence
  synthetic [barcode part1]
gcctctgcctagtagt

SEQ ID NO: 43487 - DNA, 16 bp, Artificial Sequence
  synthetic [barcode part1]
ttagagttggacgagt

SEQ ID NO: 43488 - DNA, 16 bp, Artificial Sequence
  synthetic [barcode part1]
gcgcggagtaacttag

SEQ ID NO: 43489 - DNA, 16 bp, Artificial Sequence
  synthetic [barcode part1]
aactgcagttgtgtgc

SEQ ID NO: 43490 - DNA, 16 bp, Artificial Sequence
  synthetic [barcode part1]
ttgtggtgtgtacgtg

SEQ ID NO: 43491 - DNA, 16 bp, Artificial Sequence
  synthetic [barcode part1]
agacctgcctgactct

SEQ ID NO: 43492 - DNA, 16 bp, Artificial Sequence
  synthetic [barcode part1]
attacctcacttggac

SEQ ID NO: 43493 - DNA, 16 bp, Artificial Sequence
  synthetic [barcode part1]
aacggaggacttgtgc

SEQ ID NO: 43494 - DNA, 16 bp, Artificial Sequence
  synthetic [barcode part1]
atataggagactgtcg

SEQ ID NO: 43495 - DNA, 16 bp, Artificial Sequence
  synthetic [barcode part1]
gtgcaacgtactgact

SEQ ID NO: 43496 - DNA, 16 bp, Artificial Sequence
  synthetic [barcode part1]
tggagtcaacctcagt

SEQ ID NO: 43497 - DNA, 16 bp, Artificial Sequence
  synthetic [barcode part1]
tagaaccaacctcgac

SEQ ID NO: 43498 - DNA, 16 bp, Artificial Sequence
  synthetic [barcode part1]
gcgatactctcctctt

SEQ ID NO: 43499 - DNA, 16 bp, Artificial Sequence
  synthetic [barcode part1]
ttagtataccggtgcg

SEQ ID NO: 43500 - DNA, 16 bp, Artificial Sequence
  synthetic [barcode part1]
gcgtgcaattaactgc

SEQ ID NO: 43501 - DNA, 16 bp, Artificial Sequence
  synthetic [barcode part1]
tacgcctatctagtac

SEQ ID NO: 43502 - DNA, 16 bp, Artificial Sequence
  synthetic [barcode part1]
acgtccttgatccgac

SEQ ID NO: 43503 - DNA, 16 bp, Artificial Sequence
  synthetic [barcode part1]
actcttggcgacctgt

SEQ ID NO: 43504 - DNA, 16 bp, Artificial Sequence
  synthetic [barcode part1]
agtgatcacgttcttc

SEQ ID NO: 43505 - DNA, 16 bp, Artificial Sequence
  synthetic [barcode part1]
attcaggtattgcctc

SEQ ID NO: 43506 - DNA, 16 bp, Artificial Sequence
  synthetic [barcode part1]
gtactcttcaacgact

SEQ ID NO: 43507 - DNA, 16 bp, Artificial Sequence
  synthetic [barcode part1]
cgaacgcctctcaatc

SEQ ID NO: 43508 - DNA, 16 bp, Artificial Sequence
  synthetic [barcode part1]
ttgcgattacggtacg

SEQ ID NO: 43509 - DNA, 16 bp, Artificial Sequence
  synthetic [barcode part1]
gttctgcgtagtcacc

SEQ ID NO: 43510 - DNA, 16 bp, Artificial Sequence
  synthetic [barcode part1]
cggaattcaacgttgc

SEQ ID NO: 43511 - DNA, 16 bp, Artificial Sequence
  synthetic [barcode part1]
gtccgtgttagtacag

SEQ ID NO: 43512 - DNA, 16 bp, Artificial Sequence
  synthetic [barcode part1]
gacacgtaccagtact

SEQ ID NO: 43513 - DNA, 16 bp, Artificial Sequence
  synthetic [barcode part1]
actggacaacacaagt

SEQ ID NO: 43514 - DNA, 16 bp, Artificial Sequence
  synthetic [barcode part1]
aacaccaaccagttgc

SEQ ID NO: 43515 - DNA, 16 bp, Artificial Sequence
  synthetic [barcode part1]
gaagtatctaacggtg

SEQ ID NO: 43516 - DNA, 16 bp, Artificial Sequence
  synthetic [barcode part1]
cacggaattagtagtg

SEQ ID NO: 43517 - DNA, 16 bp, Artificial Sequence
  synthetic [barcode part1]
caatcggaaggtctct

SEQ ID NO: 43518 - DNA, 16 bp, Artificial Sequence
  synthetic [barcode part1]
cgcgtcagatcagaag

SEQ ID NO: 43519 - DNA, 16 bp, Artificial Sequence
  synthetic [barcode part1]
acaatcactggagagt

SEQ ID NO: 43520 - DNA, 16 bp, Artificial Sequence
  synthetic [barcode part1]
atacgtggaccgattc

SEQ ID NO: 43521 - DNA, 16 bp, Artificial Sequence
  synthetic [barcode part1]
cgaacacgatcacgtt

SEQ ID NO: 43522 - DNA, 16 bp, Artificial Sequence
  synthetic [barcode part1]
gcgtaacgcgtcaatt

SEQ ID NO: 43523 - DNA, 16 bp, Artificial Sequence
  synthetic [barcode part1]
gtgcgtatcagtcagt

SEQ ID NO: 43524 - DNA, 16 bp, Artificial Sequence
  synthetic [barcode part1]
tcctccaagtacaccg

SEQ ID NO: 43525 - DNA, 16 bp, Artificial Sequence
  synthetic [barcode part1]
atctctgcgttcctgt

SEQ ID NO: 43526 - DNA, 16 bp, Artificial Sequence
  synthetic [barcode part1]
gtaacgcaactgacct

SEQ ID NO: 43527 - DNA, 16 bp, Artificial Sequence
  synthetic [barcode part1]
ttctaacgtgcggtcc

SEQ ID NO: 43528 - DNA, 16 bp, Artificial Sequence
  synthetic [barcode part1]
agacgaaccgttcact

SEQ ID NO: 43529 - DNA, 16 bp, Artificial Sequence
  synthetic [barcode part1]
taacgacaaggtgcgc

SEQ ID NO: 43530 - DNA, 16 bp, Artificial Sequence
  synthetic [barcode part1]
caagactcgatactgc

SEQ ID NO: 43531 - DNA, 16 bp, Artificial Sequence
  synthetic [barcode part1]
atccaggagtaagact

SEQ ID NO: 43532 - DNA, 16 bp, Artificial Sequence
  synthetic [barcode part1]
acgtgcactgactagt

SEQ ID NO: 43533 - DNA, 16 bp, Artificial Sequence
  synthetic [barcode part1]
cgtatactcctccttg

SEQ ID NO: 43534 - DNA, 16 bp, Artificial Sequence
  synthetic [barcode part1]
gcagaagaacttaacc

SEQ ID NO: 43535 - DNA, 16 bp, Artificial Sequence
  synthetic [barcode part1]
acactgtgtctacttg

SEQ ID NO: 43536 - DNA, 16 bp, Artificial Sequence
  synthetic [barcode part1]
tcaggattcgcctgtc

SEQ ID NO: 43537 - DNA, 16 bp, Artificial Sequence
  synthetic [barcode part1]
gacaatcctaagtcgc

SEQ ID NO: 43538 - DNA, 16 bp, Artificial Sequence
  synthetic [barcode part1]
caattcgccgcacttg

SEQ ID NO: 43539 - DNA, 16 bp, Artificial Sequence
  synthetic [barcode part1]
acggtcaatcggtgtt

SEQ ID NO: 43540 - DNA, 16 bp, Artificial Sequence
  synthetic [barcode part1]
gactgccgaacacaag

SEQ ID NO: 43541 - DNA, 16 bp, Artificial Sequence
  synthetic [barcode part1]
tcctggttcagtatac

SEQ ID NO: 43542 - DNA, 16 bp, Artificial Sequence
  synthetic [barcode part1]
aacaagtacggcaccg

SEQ ID NO: 43543 - DNA, 16 bp, Artificial Sequence
  synthetic [barcode part1]
actggcacctataggt

SEQ ID NO: 43544 - DNA, 16 bp, Artificial Sequence
  synthetic [barcode part1]
ccagtggtagattgtc

SEQ ID NO: 43545 - DNA, 16 bp, Artificial Sequence
  synthetic [barcode part1]
gtactggttccgtcgt

SEQ ID NO: 43546 - DNA, 16 bp, Artificial Sequence
  synthetic [barcode part1]
tcgattcagacacctt

SEQ ID NO: 43547 - DNA, 16 bp, Artificial Sequence
  synthetic [barcode part1]
ccgaagacaacaagag

SEQ ID NO: 43548 - DNA, 16 bp, Artificial Sequence
  synthetic [barcode part1]
aggacttagacaagtc

SEQ ID NO: 43549 - DNA, 16 bp, Artificial Sequence
  synthetic [barcode part1]
gcaagaggacctgatc

SEQ ID NO: 43550 - DNA, 16 bp, Artificial Sequence
  synthetic [barcode part1]
tggtgttgagtggacg

SEQ ID NO: 43551 - DNA, 16 bp, Artificial Sequence
  synthetic [barcode part1]
tgtggcacggataggt

SEQ ID NO: 43552 - DNA, 16 bp, Artificial Sequence
  synthetic [barcode part1]
aggttgtcttagtggc

SEQ ID NO: 43553 - DNA, 16 bp, Artificial Sequence
  synthetic [barcode part1]
tgcgtcgatcaatacg

SEQ ID NO: 43554 - DNA, 16 bp, Artificial Sequence
  synthetic [barcode part1]
aaggaaggtcgtagtg

SEQ ID NO: 43555 - DNA, 16 bp, Artificial Sequence
  synthetic [barcode part1]
cggtacagttatctct

SEQ ID NO: 43556 - DNA, 16 bp, Artificial Sequence
  synthetic [barcode part1]
tctctcgcaccgatag

SEQ ID NO: 43557 - DNA, 16 bp, Artificial Sequence
  synthetic [barcode part1]
tcaggccacgtagaag

SEQ ID NO: 43558 - DNA, 16 bp, Artificial Sequence
  synthetic [barcode part1]
ttgatcgcgtagtacg

SEQ ID NO: 43559 - DNA, 16 bp, Artificial Sequence
  synthetic [barcode part1]
tgttcgttgaagtcct

SEQ ID NO: 43560 - DNA, 16 bp, Artificial Sequence
  synthetic [barcode part1]
atccggaggcagagtt

SEQ ID NO: 43561 - DNA, 16 bp, Artificial Sequence
  synthetic [barcode part1]
ccagagatcaacgcag

SEQ ID NO: 43562 - DNA, 16 bp, Artificial Sequence
  synthetic [barcode part1]
tgtacttcgaactacc

SEQ ID NO: 43563 - DNA, 16 bp, Artificial Sequence
  synthetic [barcode part1]
acagatacactgcaag

SEQ ID NO: 43564 - DNA, 16 bp, Artificial Sequence
  synthetic [barcode part1]
gagattcgtagacggc

SEQ ID NO: 43565 - DNA, 16 bp, Artificial Sequence
  synthetic [barcode part1]
cacgaacttaccttgt

SEQ ID NO: 43566 - DNA, 16 bp, Artificial Sequence
  synthetic [barcode part1]
gcctctatctagtaac

SEQ ID NO: 43567 - DNA, 16 bp, Artificial Sequence
  synthetic [barcode part1]
accgttcgacgtctac

SEQ ID NO: 43568 - DNA, 16 bp, Artificial Sequence
  synthetic [barcode part1]
tgacaacaccaagtcc

SEQ ID NO: 43569 - DNA, 16 bp, Artificial Sequence
  synthetic [barcode part1]
tgaacctataggcctg

SEQ ID NO: 43570 - DNA, 16 bp, Artificial Sequence
  synthetic [barcode part1]
agtcaacactggttgc

SEQ ID NO: 43571 - DNA, 16 bp, Artificial Sequence
  synthetic [barcode part1]
cagagtgacgattgcg

SEQ ID NO: 43572 - DNA, 16 bp, Artificial Sequence
  synthetic [barcode part1]
gtgtacagaccaactc

SEQ ID NO: 43573 - DNA, 16 bp, Artificial Sequence
  synthetic [barcode part1]
cacaggcacaacgaac

SEQ ID NO: 43574 - DNA, 16 bp, Artificial Sequence
  synthetic [barcode part1]
aacctccagtcgtacc

SEQ ID NO: 43575 - DNA, 16 bp, Artificial Sequence
  synthetic [barcode part1]
ttgtcaccgcctaggt

SEQ ID NO: 43576 - DNA, 16 bp, Artificial Sequence
  synthetic [barcode part1]
accgcctctgcgaatt

SEQ ID NO: 43577 - DNA, 16 bp, Artificial Sequence
  synthetic [barcode part1]
tgaactcaacagagtg

SEQ ID NO: 43578 - DNA, 16 bp, Artificial Sequence
  synthetic [barcode part1]
caaggccaaccttaac

SEQ ID NO: 43579 - DNA, 16 bp, Artificial Sequence
  synthetic [barcode part1]
ccggttgtaataccag

SEQ ID NO: 43580 - DNA, 16 bp, Artificial Sequence
  synthetic [barcode part1]
accaccgattggattg

SEQ ID NO: 43581 - DNA, 16 bp, Artificial Sequence
  synthetic [barcode part1]
ccttgcgagttcaatt

SEQ ID NO: 43582 - DNA, 16 bp, Artificial Sequence
  synthetic [barcode part1]
acgttgtgcctacctg

SEQ ID NO: 43583 - DNA, 16 bp, Artificial Sequence
  synthetic [barcode part1]
tctatactggcaactc

SEQ ID NO: 43584 - DNA, 16 bp, Artificial Sequence
  synthetic [barcode part1]
gtgagagttgaactac

SEQ ID NO: 43585 - DNA, 16 bp, Artificial Sequence
  synthetic [barcode part1]
gaatcggaccgtacag

SEQ ID NO: 43586 - DNA, 16 bp, Artificial Sequence
  synthetic [barcode part1]
agtgtcgtctcctctt

SEQ ID NO: 43587 - DNA, 16 bp, Artificial Sequence
  synthetic [barcode part1]
tgccagactatcaggt

SEQ ID NO: 43588 - DNA, 16 bp, Artificial Sequence
  synthetic [barcode part1]
agatatctgagacggt

SEQ ID NO: 43589 - DNA, 16 bp, Artificial Sequence
  synthetic [barcode part1]
gatcctcctgacgtac

SEQ ID NO: 43590 - DNA, 16 bp, Artificial Sequence
  synthetic [barcode part1]
tgtgacgtacctgcct

SEQ ID NO: 43591 - DNA, 16 bp, Artificial Sequence
  synthetic [barcode part1]
acagtcagatcaagac

SEQ ID NO: 43592 - DNA, 16 bp, Artificial Sequence
  synthetic [barcode part1]
aggcgtcttcagatac

SEQ ID NO: 43593 - DNA, 16 bp, Artificial Sequence
  synthetic [barcode part1]
tgtacgagtgagacgc

SEQ ID NO: 43594 - DNA, 16 bp, Artificial Sequence
  synthetic [barcode part1]
gactgcaggttgaggt

SEQ ID NO: 43595 - DNA, 16 bp, Artificial Sequence
  synthetic [barcode part1]
acactccttggactgc

SEQ ID NO: 43596 - DNA, 16 bp, Artificial Sequence
  synthetic [barcode part1]
tgtgtacgtactgcag

SEQ ID NO: 43597 - DNA, 16 bp, Artificial Sequence
  synthetic [barcode part1]
cgcaacgacagacaac

SEQ ID NO: 43598 - DNA, 16 bp, Artificial Sequence
  synthetic [barcode part1]
agtacacgtcaacgtc

SEQ ID NO: 43599 - DNA, 16 bp, Artificial Sequence
  synthetic [barcode part1]
tgcgtgatctagttct

SEQ ID NO: 43600 - DNA, 16 bp, Artificial Sequence
  synthetic [barcode part1]
tagaagacaacgcgcc

SEQ ID NO: 43601 - DNA, 16 bp, Artificial Sequence
  synthetic [barcode part1]
ttgcgagtctggcctt

SEQ ID NO: 43602 - DNA, 16 bp, Artificial Sequence
  synthetic [barcode part1]
gatctgagactcgatc

SEQ ID NO: 43603 - DNA, 16 bp, Artificial Sequence
  synthetic [barcode part1]
acggttaccgatctcc

SEQ ID NO: 43604 - DNA, 16 bp, Artificial Sequence
  synthetic [barcode part1]
aactgatacgccgtgt

SEQ ID NO: 43605 - DNA, 16 bp, Artificial Sequence
  synthetic [barcode part1]
gtatctccgtgtcctt

SEQ ID NO: 43606 - DNA, 16 bp, Artificial Sequence
  synthetic [barcode part1]
ccacttaacttcgagt

SEQ ID NO: 43607 - DNA, 16 bp, Artificial Sequence
  synthetic [barcode part1]
tctagtccgtacaact

SEQ ID NO: 43608 - DNA, 16 bp, Artificial Sequence
  synthetic [barcode part1]
tcggcggttgtactct

SEQ ID NO: 43609 - DNA, 16 bp, Artificial Sequence
  synthetic [barcode part1]
ttaggtcaatccggtg

SEQ ID NO: 43610 - DNA, 16 bp, Artificial Sequence
  synthetic [barcode part1]
acacctattgcagacg

SEQ ID NO: 43611 - DNA, 16 bp, Artificial Sequence
  synthetic [barcode part1]
actgtccgaacctacc

SEQ ID NO: 43612 - DNA, 16 bp, Artificial Sequence
  synthetic [barcode part1]
ttccaatcgacctctc

SEQ ID NO: 43613 - DNA, 16 bp, Artificial Sequence
  synthetic [barcode part1]
aagactcaggcggatc

SEQ ID NO: 43614 - DNA, 16 bp, Artificial Sequence
  synthetic [barcode part1]
agtcacgaggagacct

SEQ ID NO: 43615 - DNA, 16 bp, Artificial Sequence
  synthetic [barcode part1]
tccgactgtactggtc

SEQ ID NO: 43616 - DNA, 16 bp, Artificial Sequence
  synthetic [barcode part1]
aggcgattgcagactg

SEQ ID NO: 43617 - DNA, 16 bp, Artificial Sequence
  synthetic [barcode part1]
cctcagtaattgtgtc

SEQ ID NO: 43618 - DNA, 16 bp, Artificial Sequence
  synthetic [barcode part1]
aagacctctcagagtc

SEQ ID NO: 43619 - DNA, 16 bp, Artificial Sequence
  synthetic [barcode part1]
ttgcctccaactcttg

SEQ ID NO: 43620 - DNA, 16 bp, Artificial Sequence
  synthetic [barcode part1]
tggatactctcactac

SEQ ID NO: 43621 - DNA, 16 bp, Artificial Sequence
  synthetic [barcode part1]
cactaaggtctccacc

SEQ ID NO: 43622 - DNA, 16 bp, Artificial Sequence
  synthetic [barcode part1]
cgtcagattcagtggt

SEQ ID NO: 43623 - DNA, 16 bp, Artificial Sequence
  synthetic [barcode part1]
cgacgatactgtcagt

SEQ ID NO: 43624 - DNA, 16 bp, Artificial Sequence
  synthetic [barcode part1]
ccgcgtattcttcgag

SEQ ID NO: 43625 - DNA, 16 bp, Artificial Sequence
  synthetic [barcode part1]
gcagaacaggtctacg

SEQ ID NO: 43626 - DNA, 16 bp, Artificial Sequence
  synthetic [barcode part1]
cggattaagtccagtc

SEQ ID NO: 43627 - DNA, 16 bp, Artificial Sequence
  synthetic [barcode part1]
attactcgatatccgc

SEQ ID NO: 43628 - DNA, 16 bp, Artificial Sequence
  synthetic [barcode part1]
ttgacgttgtgcagtg

SEQ ID NO: 43629 - DNA, 16 bp, Artificial Sequence
  synthetic [barcode part1]
tcctggcactacttct

SEQ ID NO: 43630 - DNA, 16 bp, Artificial Sequence
  synthetic [barcode part1]
cacactagtatcgacg

SEQ ID NO: 43631 - DNA, 16 bp, Artificial Sequence
  synthetic [barcode part1]
tgaacgtgactacacc

SEQ ID NO: 43632 - DNA, 16 bp, Artificial Sequence
  synthetic [barcode part1]
cacagattagaacgac

SEQ ID NO: 43633 - DNA, 16 bp, Artificial Sequence
  synthetic [barcode part1]
tcagacggtcttatct

SEQ ID NO: 43634 - DNA, 16 bp, Artificial Sequence
  synthetic [barcode part1]
actcaaggcaacggac

SEQ ID NO: 43635 - DNA, 16 bp, Artificial Sequence
  synthetic [barcode part1]
tcaccactccggatac

SEQ ID NO: 43636 - DNA, 16 bp, Artificial Sequence
  synthetic [barcode part1]
cacttgatctcgccag

SEQ ID NO: 43637 - DNA, 16 bp, Artificial Sequence
  synthetic [barcode part1]
cggtaacaccgaatct

SEQ ID NO: 43638 - DNA, 16 bp, Artificial Sequence
  synthetic [barcode part1]
cctcgacgtattcggt

SEQ ID NO: 43639 - DNA, 16 bp, Artificial Sequence
  synthetic [barcode part1]
gagtatccagaacggc

SEQ ID NO: 43640 - DNA, 16 bp, Artificial Sequence
  synthetic [barcode part1]
cctcgttatagatctg

SEQ ID NO: 43641 - DNA, 16 bp, Artificial Sequence
  synthetic [barcode part1]
cgaccgttactaacag

SEQ ID NO: 43642 - DNA, 16 bp, Artificial Sequence
  synthetic [barcode part1]
aacgttggtacacacc

SEQ ID NO: 43643 - DNA, 16 bp, Artificial Sequence
  synthetic [barcode part1]
gacctggtgataactc

SEQ ID NO: 43644 - DNA, 16 bp, Artificial Sequence
  synthetic [barcode part1]
gaacctgtgttctgtt

SEQ ID NO: 43645 - DNA, 16 bp, Artificial Sequence
  synthetic [barcode part1]
caatcggttccagagt

SEQ ID NO: 43646 - DNA, 16 bp, Artificial Sequence
  synthetic [barcode part1]
tgtctgagactacgtg

SEQ ID NO: 43647 - DNA, 16 bp, Artificial Sequence
  synthetic [barcode part1]
acactgtactccagag

SEQ ID NO: 43648 - DNA, 16 bp, Artificial Sequence
  synthetic [barcode part1]
aaccacagactaagac

SEQ ID NO: 43649 - DNA, 16 bp, Artificial Sequence
  synthetic [barcode part1]
gcggagaatacttcct

SEQ ID NO: 43650 - DNA, 16 bp, Artificial Sequence
  synthetic [barcode part1]
tggaactccagagttc

SEQ ID NO: 43651 - DNA, 16 bp, Artificial Sequence
  synthetic [barcode part1]
gaagtatctctgcacg

SEQ ID NO: 43652 - DNA, 16 bp, Artificial Sequence
  synthetic [barcode part1]
tacgtgtcaaccaacg

SEQ ID NO: 43653 - DNA, 16 bp, Artificial Sequence
  synthetic [barcode part1]
tgtcgcggtgttatag

SEQ ID NO: 43654 - DNA, 16 bp, Artificial Sequence
  synthetic [barcode part1]
ttgtcgattctgtacg

SEQ ID NO: 43655 - DNA, 16 bp, Artificial Sequence
  synthetic [barcode part1]
ttctgtggaggtacgt

SEQ ID NO: 43656 - DNA, 16 bp, Artificial Sequence
  synthetic [barcode part1]
cgtggtaatctacctt

SEQ ID NO: 43657 - DNA, 16 bp, Artificial Sequence
  synthetic [barcode part1]
accaagtaagtgcaac

SEQ ID NO: 43658 - DNA, 16 bp, Artificial Sequence
  synthetic [barcode part1]
gtctactcttaggact

SEQ ID NO: 43659 - DNA, 16 bp, Artificial Sequence
  synthetic [barcode part1]
aattaggtggacctag

SEQ ID NO: 43660 - DNA, 16 bp, Artificial Sequence
  synthetic [barcode part1]
actgcctcacctagac

SEQ ID NO: 43661 - DNA, 16 bp, Artificial Sequence
  synthetic [barcode part1]
gagtgaaggacagact

SEQ ID NO: 43662 - DNA, 16 bp, Artificial Sequence
  synthetic [barcode part1]
aggttggttctgactg

SEQ ID NO: 43663 - DNA, 16 bp, Artificial Sequence
  synthetic [barcode part1]
agttgtctcgttggag

SEQ ID NO: 43664 - DNA, 16 bp, Artificial Sequence
  synthetic [barcode part1]
gaacgagtctgttcac

SEQ ID NO: 43665 - DNA, 16 bp, Artificial Sequence
  synthetic [barcode part1]
gataagtcgagacttg

SEQ ID NO: 43666 - DNA, 16 bp, Artificial Sequence
  synthetic [barcode part1]
ttcggtatactctcag

SEQ ID NO: 43667 - DNA, 16 bp, Artificial Sequence
  synthetic [barcode part1]
tatcgttggtgtgttc

SEQ ID NO: 43668 - DNA, 16 bp, Artificial Sequence
  synthetic [barcode part1]
gttactcgcagatctt

SEQ ID NO: 43669 - DNA, 16 bp, Artificial Sequence
  synthetic [barcode part1]
cctattgacgcaatct

SEQ ID NO: 43670 - DNA, 16 bp, Artificial Sequence
  synthetic [barcode part1]
tgcgacaagacagatt

SEQ ID NO: 43671 - DNA, 16 bp, Artificial Sequence
  synthetic [barcode part1]
gttactcgcgaattct

SEQ ID NO: 43672 - DNA, 16 bp, Artificial Sequence
  synthetic [barcode part1]
ttgcctagataccact

SEQ ID NO: 43673 - DNA, 16 bp, Artificial Sequence
  synthetic [barcode part1]
actgtggacctgcctt

SEQ ID NO: 43674 - DNA, 16 bp, Artificial Sequence
  synthetic [barcode part1]
cacaaggcggtgattg

SEQ ID NO: 43675 - DNA, 16 bp, Artificial Sequence
  synthetic [barcode part1]
cacgtgacagagaatt

SEQ ID NO: 43676 - DNA, 16 bp, Artificial Sequence
  synthetic [barcode part1]
ccgttctggagattag

SEQ ID NO: 43677 - DNA, 16 bp, Artificial Sequence
  synthetic [barcode part1]
gtgcagtaattgaggt

SEQ ID NO: 43678 - DNA, 16 bp, Artificial Sequence
  synthetic [barcode part1]
atatccttcggtaacc

SEQ ID NO: 43679 - DNA, 16 bp, Artificial Sequence
  synthetic [barcode part1]
gactatcgagtgcgag

SEQ ID NO: 43680 - DNA, 16 bp, Artificial Sequence
  synthetic [barcode part1]
attgatagttcctcgc

SEQ ID NO: 43681 - DNA, 16 bp, Artificial Sequence
  synthetic [barcode part1]
ccagttactctctctg

SEQ ID NO: 43682 - DNA, 16 bp, Artificial Sequence
  synthetic [barcode part1]
ttcttggttggcctct

SEQ ID NO: 43683 - DNA, 16 bp, Artificial Sequence
  synthetic [barcode part1]
tgcggtaacagtgtct

SEQ ID NO: 43684 - DNA, 16 bp, Artificial Sequence
  synthetic [barcode part1]
tggaggtcaagaacag

SEQ ID NO: 43685 - DNA, 16 bp, Artificial Sequence
  synthetic [barcode part1]
tgttgacgttggtgtg

SEQ ID NO: 43686 - DNA, 16 bp, Artificial Sequence
  synthetic [barcode part1]
acttacgagtcgtacg

SEQ ID NO: 43687 - DNA, 16 bp, Artificial Sequence
  synthetic [barcode part1]
tgcgcaggtaactatc

SEQ ID NO: 43688 - DNA, 16 bp, Artificial Sequence
  synthetic [barcode part1]
agtctgttgtcgtccg

SEQ ID NO: 43689 - DNA, 16 bp, Artificial Sequence
  synthetic [barcode part1]
tgactcaggtgatctg

SEQ ID NO: 43690 - DNA, 16 bp, Artificial Sequence
  synthetic [barcode part1]
acggattctctactac

SEQ ID NO: 43691 - DNA, 16 bp, Artificial Sequence
  synthetic [barcode part1]
taggatcgttgaccac

SEQ ID NO: 43692 - DNA, 16 bp, Artificial Sequence
  synthetic [barcode part1]
gtaggcagacgttgtg

SEQ ID NO: 43693 - DNA, 16 bp, Artificial Sequence
  synthetic [barcode part1]
actgagttggaggtgc

SEQ ID NO: 43694 - DNA, 16 bp, Artificial Sequence
  synthetic [barcode part1]
tactctggcagatctt

SEQ ID NO: 43695 - DNA, 16 bp, Artificial Sequence
  synthetic [barcode part1]
aataggtggcgtcgtg

SEQ ID NO: 43696 - DNA, 16 bp, Artificial Sequence
  synthetic [barcode part1]
gtgattgccttaactc

SEQ ID NO: 43697 - DNA, 16 bp, Artificial Sequence
  synthetic [barcode part1]
ttcgcctatctactcg

SEQ ID NO: 43698 - DNA, 16 bp, Artificial Sequence
  synthetic [barcode part1]
tgaccgatctctctct

SEQ ID NO: 43699 - DNA, 16 bp, Artificial Sequence
  synthetic [barcode part1]
gactgtactctctggc

SEQ ID NO: 43700 - DNA, 16 bp, Artificial Sequence
  synthetic [barcode part1]
cagtaggtatccggag

SEQ ID NO: 43701 - DNA, 16 bp, Artificial Sequence
  synthetic [barcode part1]
tgaccaacaactgacc

SEQ ID NO: 43702 - DNA, 16 bp, Artificial Sequence
  synthetic [barcode part1]
acgtaacctaaggaac

SEQ ID NO: 43703 - DNA, 16 bp, Artificial Sequence
  synthetic [barcode part1]
ataggatccactccag

SEQ ID NO: 43704 - DNA, 16 bp, Artificial Sequence
  synthetic [barcode part1]
tcggataagtactcgc

SEQ ID NO: 43705 - DNA, 16 bp, Artificial Sequence
  synthetic [barcode part1]
gcgatatacacgtacc

SEQ ID NO: 43706 - DNA, 16 bp, Artificial Sequence
  synthetic [barcode part1]
cctacgtcgatagtcc

SEQ ID NO: 43707 - DNA, 16 bp, Artificial Sequence
  synthetic [barcode part1]
acagatcacacggttc

SEQ ID NO: 43708 - DNA, 16 bp, Artificial Sequence
  synthetic [barcode part1]
cctagatactcgaacg

SEQ ID NO: 43709 - DNA, 16 bp, Artificial Sequence
  synthetic [barcode part1]
gcgttgacgtgttagt

SEQ ID NO: 43710 - DNA, 16 bp, Artificial Sequence
  synthetic [barcode part1]
cgtccacttactcact

SEQ ID NO: 43711 - DNA, 16 bp, Artificial Sequence
  synthetic [barcode part1]
tgatcaggactgactc

SEQ ID NO: 43712 - DNA, 16 bp, Artificial Sequence
  synthetic [barcode part1]
caggccttaggtattg

SEQ ID NO: 43713 - DNA, 16 bp, Artificial Sequence
  synthetic [barcode part1]
ttggccgtatagtacg

SEQ ID NO: 43714 - DNA, 16 bp, Artificial Sequence
  synthetic [barcode part1]
cgaacgatctatccag

SEQ ID NO: 43715 - DNA, 16 bp, Artificial Sequence
  synthetic [barcode part1]
acctaactcggtagtg

SEQ ID NO: 43716 - DNA, 16 bp, Artificial Sequence
  synthetic [barcode part1]
ccgactgtaatcagtg

SEQ ID NO: 43717 - DNA, 16 bp, Artificial Sequence
  synthetic [barcode part1]
tgcgaatacaacagac

SEQ ID NO: 43718 - DNA, 16 bp, Artificial Sequence
  synthetic [barcode part1]
agaataacgaacgcct

SEQ ID NO: 43719 - DNA, 16 bp, Artificial Sequence
  synthetic [barcode part1]
gcctgtcactctgagt

SEQ ID NO: 43720 - DNA, 16 bp, Artificial Sequence
  synthetic [barcode part1]
gttagacgaacacggc

SEQ ID NO: 43721 - DNA, 16 bp, Artificial Sequence
  synthetic [barcode part1]
gattacgtgactgcac

SEQ ID NO: 43722 - DNA, 16 bp, Artificial Sequence
  synthetic [barcode part1]
gatcttgagataggtg

SEQ ID NO: 43723 - DNA, 16 bp, Artificial Sequence
  synthetic [barcode part1]
cctcgtactgaattac

SEQ ID NO: 43724 - DNA, 16 bp, Artificial Sequence
  synthetic [barcode part1]
gaattgcgacgacttc

SEQ ID NO: 43725 - DNA, 16 bp, Artificial Sequence
  synthetic [barcode part1]
caatacggaggactgc

SEQ ID NO: 43726 - DNA, 16 bp, Artificial Sequence
  synthetic [barcode part1]
gtcctgtcaggtctac

SEQ ID NO: 43727 - DNA, 16 bp, Artificial Sequence
  synthetic [barcode part1]
tcacgattcgactgag

SEQ ID NO: 43728 - DNA, 16 bp, Artificial Sequence
  synthetic [barcode part1]
tcgcaccaacgacctt

SEQ ID NO: 43729 - DNA, 16 bp, Artificial Sequence
  synthetic [barcode part1]
gactaatactggccgt

SEQ ID NO: 43730 - DNA, 16 bp, Artificial Sequence
  synthetic [barcode part1]
tcacgtaggccaagag

SEQ ID NO: 43731 - DNA, 16 bp, Artificial Sequence
  synthetic [barcode part1]
gaactgtactcctatc

SEQ ID NO: 43732 - DNA, 16 bp, Artificial Sequence
  synthetic [barcode part1]
gaatattcctatcgcc

SEQ ID NO: 43733 - DNA, 16 bp, Artificial Sequence
  synthetic [barcode part1]
actatctctcgtcacc

SEQ ID NO: 43734 - DNA, 16 bp, Artificial Sequence
  synthetic [barcode part1]
tccggtgtccaataag

SEQ ID NO: 43735 - DNA, 16 bp, Artificial Sequence
  synthetic [barcode part1]
tacgtcagttgacgtg

SEQ ID NO: 43736 - DNA, 16 bp, Artificial Sequence
  synthetic [barcode part1]
tcggagaccagtacag

SEQ ID NO: 43737 - DNA, 16 bp, Artificial Sequence
  synthetic [barcode part1]
gatctcaatagtgccg

SEQ ID NO: 43738 - DNA, 16 bp, Artificial Sequence
  synthetic [barcode part1]
gacttgtgcggtagag

SEQ ID NO: 43739 - DNA, 16 bp, Artificial Sequence
  synthetic [barcode part1]
tccttgcgaattatcg

SEQ ID NO: 43740 - DNA, 16 bp, Artificial Sequence
  synthetic [barcode part1]
aggaccactgagtgtg

SEQ ID NO: 43741 - DNA, 16 bp, Artificial Sequence
  synthetic [barcode part1]
atcgacagtccaagtc

SEQ ID NO: 43742 - DNA, 16 bp, Artificial Sequence
  synthetic [barcode part1]
gcgtgtaaggatcctt

SEQ ID NO: 43743 - DNA, 16 bp, Artificial Sequence
  synthetic [barcode part1]
gtgtacgagtcagtct

SEQ ID NO: 43744 - DNA, 16 bp, Artificial Sequence
  synthetic [barcode part1]
ttccgatcctccaact

SEQ ID NO: 43745 - DNA, 16 bp, Artificial Sequence
  synthetic [barcode part1]
accactagtattcctg

SEQ ID NO: 43746 - DNA, 16 bp, Artificial Sequence
  synthetic [barcode part1]
gttgaacagtgactcc

SEQ ID NO: 43747 - DNA, 16 bp, Artificial Sequence
  synthetic [barcode part1]
cggtagacttgttacg

SEQ ID NO: 43748 - DNA, 16 bp, Artificial Sequence
  synthetic [barcode part1]
agaggacaagttaggc

SEQ ID NO: 43749 - DNA, 16 bp, Artificial Sequence
  synthetic [barcode part1]
ttgcctaccgcagtgt

SEQ ID NO: 43750 - DNA, 16 bp, Artificial Sequence
  synthetic [barcode part1]
actatctccacagatc

SEQ ID NO: 43751 - DNA, 16 bp, Artificial Sequence
  synthetic [barcode part1]
gtggaacggatagtag

SEQ ID NO: 43752 - DNA, 16 bp, Artificial Sequence
  synthetic [barcode part1]
ttgttggtcgacaacg

SEQ ID NO: 43753 - DNA, 16 bp, Artificial Sequence
  synthetic [barcode part1]
aggtaatcctccaacg

SEQ ID NO: 43754 - DNA, 16 bp, Artificial Sequence
  synthetic [barcode part1]
tgtcctagtggattct

SEQ ID NO: 43755 - DNA, 16 bp, Artificial Sequence
  synthetic [barcode part1]
attagaggcactggcg

SEQ ID NO: 43756 - DNA, 16 bp, Artificial Sequence
  synthetic [barcode part1]
tggacgattgttcgtg

SEQ ID NO: 43757 - DNA, 16 bp, Artificial Sequence
  synthetic [barcode part1]
acttggtctccgtacg

SEQ ID NO: 43758 - DNA, 16 bp, Artificial Sequence
  synthetic [barcode part1]
cctccggcagtatatc

SEQ ID NO: 43759 - DNA, 16 bp, Artificial Sequence
  synthetic [barcode part1]
gtcgccttactcaggt

SEQ ID NO: 43760 - DNA, 16 bp, Artificial Sequence
  synthetic [barcode part1]
gtatcttgtcactgac

SEQ ID NO: 43761 - DNA, 16 bp, Artificial Sequence
  synthetic [barcode part1]
atccaccgcggtattc

SEQ ID NO: 43762 - DNA, 16 bp, Artificial Sequence
  synthetic [barcode part1]
tgatcttcgcgtggtc

SEQ ID NO: 43763 - DNA, 16 bp, Artificial Sequence
  synthetic [barcode part1]
ccagtaatcactggac

SEQ ID NO: 43764 - DNA, 16 bp, Artificial Sequence
  synthetic [barcode part1]
atcctgaggttagtcg

SEQ ID NO: 43765 - DNA, 16 bp, Artificial Sequence
  synthetic [barcode part1]
gtcactaataccttcg

SEQ ID NO: 43766 - DNA, 16 bp, Artificial Sequence
  synthetic [barcode part1]
actacagaggttccac

SEQ ID NO: 43767 - DNA, 16 bp, Artificial Sequence
  synthetic [barcode part1]
cagacgccaattcctc

SEQ ID NO: 43768 - DNA, 16 bp, Artificial Sequence
  synthetic [barcode part1]
acaactactggtctct

SEQ ID NO: 43769 - DNA, 16 bp, Artificial Sequence
  synthetic [barcode part1]
gttacagataagtggc

SEQ ID NO: 43770 - DNA, 16 bp, Artificial Sequence
  synthetic [barcode part1]
tgccagagagttacct

SEQ ID NO: 43771 - DNA, 16 bp, Artificial Sequence
  synthetic [barcode part1]
agttcttgacttgcac

SEQ ID NO: 43772 - DNA, 16 bp, Artificial Sequence
  synthetic [barcode part1]
gatcgacgagaagagt

SEQ ID NO: 43773 - DNA, 16 bp, Artificial Sequence
  synthetic [barcode part1]
gtgccgataacctctc

SEQ ID NO: 43774 - DNA, 16 bp, Artificial Sequence
  synthetic [barcode part1]
caagatcgtaccgtac

SEQ ID NO: 43775 - DNA, 16 bp, Artificial Sequence
  synthetic [barcode part1]
ccgcgtactagagaag

SEQ ID NO: 43776 - DNA, 16 bp, Artificial Sequence
  synthetic [barcode part1]
gtattgcctcaagacg

SEQ ID NO: 43777 - DNA, 16 bp, Artificial Sequence
  synthetic [barcode part1]
gttggttgactgactg

SEQ ID NO: 43778 - DNA, 16 bp, Artificial Sequence
  synthetic [barcode part1]
acgaggtgtagatccg

SEQ ID NO: 43779 - DNA, 16 bp, Artificial Sequence
  synthetic [barcode part1]
ttcaccgttagtgcgc

SEQ ID NO: 43780 - DNA, 16 bp, Artificial Sequence
  synthetic [barcode part1]
actggcctcagttaag

SEQ ID NO: 43781 - DNA, 16 bp, Artificial Sequence
  synthetic [barcode part1]
tcggttaccagaatcg

SEQ ID NO: 43782 - DNA, 16 bp, Artificial Sequence
  synthetic [barcode part1]
cagtgcgagagattgc

SEQ ID NO: 43783 - DNA, 16 bp, Artificial Sequence
  synthetic [barcode part1]
ttccaatccagtgtac

SEQ ID NO: 43784 - DNA, 16 bp, Artificial Sequence
  synthetic [barcode part1]
cgagatcacacgtact

SEQ ID NO: 43785 - DNA, 16 bp, Artificial Sequence
  synthetic [barcode part1]
taccagtctgattctg

SEQ ID NO: 43786 - DNA, 16 bp, Artificial Sequence
  synthetic [barcode part1]
gattacctcacacttg

SEQ ID NO: 43787 - DNA, 16 bp, Artificial Sequence
  synthetic [barcode part1]
gcaagtcggagtgact

SEQ ID NO: 43788 - DNA, 16 bp, Artificial Sequence
  synthetic [barcode part1]
tagatcgaagaacacc

SEQ ID NO: 43789 - DNA, 16 bp, Artificial Sequence
  synthetic [barcode part1]
tgaggaggttgtatac

SEQ ID NO: 43790 - DNA, 16 bp, Artificial Sequence
  synthetic [barcode part1]
tgaactaccttcgtgt

SEQ ID NO: 43791 - DNA, 16 bp, Artificial Sequence
  synthetic [barcode part1]
atcacgagtcctgaac

SEQ ID NO: 43792 - DNA, 16 bp, Artificial Sequence
  synthetic [barcode part1]
actctagtgactggtg

SEQ ID NO: 43793 - DNA, 16 bp, Artificial Sequence
  synthetic [barcode part1]
acttaaggtggcaagt

SEQ ID NO: 43794 - DNA, 16 bp, Artificial Sequence
  synthetic [barcode part1]
gtgtgtggactaacct

SEQ ID NO: 43795 - DNA, 16 bp, Artificial Sequence
  synthetic [barcode part1]
agtctaattccgcact

SEQ ID NO: 43796 - DNA, 16 bp, Artificial Sequence
  synthetic [barcode part1]
gcgcaggagattgttg

SEQ ID NO: 43797 - DNA, 16 bp, Artificial Sequence
  synthetic [barcode part1]
gtcttcggtaagaacc

SEQ ID NO: 43798 - DNA, 16 bp, Artificial Sequence
  synthetic [barcode part1]
acgagtgtgttgcgag

SEQ ID NO: 43799 - DNA, 16 bp, Artificial Sequence
  synthetic [barcode part1]
caaggttctccagaac

SEQ ID NO: 43800 - DNA, 16 bp, Artificial Sequence
  synthetic [barcode part1]
ccgtctatactcgttc

SEQ ID NO: 43801 - DNA, 16 bp, Artificial Sequence
  synthetic [barcode part1]
taccttactcgaacac

SEQ ID NO: 43802 - DNA, 16 bp, Artificial Sequence
  synthetic [barcode part1]
tacgacttcttcaacg

SEQ ID NO: 43803 - DNA, 16 bp, Artificial Sequence
  synthetic [barcode part1]
gtctcgtgcgattacc

SEQ ID NO: 43804 - DNA, 16 bp, Artificial Sequence
  synthetic [barcode part1]
tgcgtgaggtacactt

SEQ ID NO: 43805 - DNA, 16 bp, Artificial Sequence
  synthetic [barcode part1]
ttgccacttactccac

SEQ ID NO: 43806 - DNA, 16 bp, Artificial Sequence
  synthetic [barcode part1]
cctaattactgtgcac

SEQ ID NO: 43807 - DNA, 16 bp, Artificial Sequence
  synthetic [barcode part1]
tgtagacgaactcacc

SEQ ID NO: 43808 - DNA, 16 bp, Artificial Sequence
  synthetic [barcode part1]
accgcggtctagaatt

SEQ ID NO: 43809 - DNA, 16 bp, Artificial Sequence
  synthetic [barcode part1]
cgttgttgcctaagtt

SEQ ID NO: 43810 - DNA, 16 bp, Artificial Sequence
  synthetic [barcode part1]
caaggtgtaaggaacg

SEQ ID NO: 43811 - DNA, 16 bp, Artificial Sequence
  synthetic [barcode part1]
ttgtcgttgtcgtcct

SEQ ID NO: 43812 - DNA, 16 bp, Artificial Sequence
  synthetic [barcode part1]
attcggacttgaacgc

SEQ ID NO: 43813 - DNA, 16 bp, Artificial Sequence
  synthetic [barcode part1]
gtattcgtcacagacg

SEQ ID NO: 43814 - DNA, 16 bp, Artificial Sequence
  synthetic [barcode part1]
taacggtgtattctcc

SEQ ID NO: 43815 - DNA, 16 bp, Artificial Sequence
  synthetic [barcode part1]
gaataccactcgtgac

SEQ ID NO: 43816 - DNA, 16 bp, Artificial Sequence
  synthetic [barcode part1]
ttaggacgacgttacc

SEQ ID NO: 43817 - DNA, 16 bp, Artificial Sequence
  synthetic [barcode part1]
aacttgccactgcctg

SEQ ID NO: 43818 - DNA, 16 bp, Artificial Sequence
  synthetic [barcode part1]
cgattaggagaaggac

SEQ ID NO: 43819 - DNA, 16 bp, Artificial Sequence
  synthetic [barcode part1]
gatcagttacgtgcac

SEQ ID NO: 43820 - DNA, 16 bp, Artificial Sequence
  synthetic [barcode part1]
tcagatactacctcgt

SEQ ID NO: 43821 - DNA, 16 bp, Artificial Sequence
  synthetic [barcode part1]
agtcgttgttcgacag

SEQ ID NO: 43822 - DNA, 16 bp, Artificial Sequence
  synthetic [barcode part1]
tcagaacgccttagac

SEQ ID NO: 43823 - DNA, 16 bp, Artificial Sequence
  synthetic [barcode part1]
cgttacctcgttactc

SEQ ID NO: 43824 - DNA, 16 bp, Artificial Sequence
  synthetic [barcode part1]
tggtgcaggttacgtt

SEQ ID NO: 43825 - DNA, 16 bp, Artificial Sequence
  synthetic [barcode part1]
caggtgtagtctgtgt

SEQ ID NO: 43826 - DNA, 16 bp, Artificial Sequence
  synthetic [barcode part1]
agacaggatcctaggc

SEQ ID NO: 43827 - DNA, 16 bp, Artificial Sequence
  synthetic [barcode part1]
gagttctgtgtcacag

SEQ ID NO: 43828 - DNA, 16 bp, Artificial Sequence
  synthetic [barcode part1]
gagacagttcagacgc

SEQ ID NO: 43829 - DNA, 16 bp, Artificial Sequence
  synthetic [barcode part1]
caccgtccgaattcgt

SEQ ID NO: 43830 - DNA, 16 bp, Artificial Sequence
  synthetic [barcode part1]
tgcagaggattcggtg

SEQ ID NO: 43831 - DNA, 16 bp, Artificial Sequence
  synthetic [barcode part1]
gttgttgacgtcctcg

SEQ ID NO: 43832 - DNA, 16 bp, Artificial Sequence
  synthetic [barcode part1]
gcgtgcgcaattgatt

SEQ ID NO: 43833 - DNA, 16 bp, Artificial Sequence
  synthetic [barcode part1]
acgtgacagaattggt

SEQ ID NO: 43834 - DNA, 16 bp, Artificial Sequence
  synthetic [barcode part1]
tctagttcgcaatcac

SEQ ID NO: 43835 - DNA, 16 bp, Artificial Sequence
  synthetic [barcode part1]
tcgtgaacttggcctc

SEQ ID NO: 43836 - DNA, 16 bp, Artificial Sequence
  synthetic [barcode part1]
cgtatacgcgtatacg

SEQ ID NO: 43837 - DNA, 16 bp, Artificial Sequence
  synthetic [barcode part1]
acaagtcggttacgtc

SEQ ID NO: 43838 - DNA, 16 bp, Artificial Sequence
  synthetic [barcode part1]
gtggcacgattctaac

SEQ ID NO: 43839 - DNA, 16 bp, Artificial Sequence
  synthetic [barcode part1]
gacgagacacggattc

SEQ ID NO: 43840 - DNA, 16 bp, Artificial Sequence
  synthetic [barcode part1]
gtgagtgtctaaggcg

SEQ ID NO: 43841 - DNA, 16 bp, Artificial Sequence
  synthetic [barcode part1]
cgagtacgttgcctct

SEQ ID NO: 43842 - DNA, 16 bp, Artificial Sequence
  synthetic [barcode part1]
aacctaacgtgagagt

SEQ ID NO: 43843 - DNA, 16 bp, Artificial Sequence
  synthetic [barcode part1]
cacgtagatcttctgt

SEQ ID NO: 43844 - DNA, 16 bp, Artificial Sequence
  synthetic [barcode part1]
ccgtcgtgttctatct

SEQ ID NO: 43845 - DNA, 16 bp, Artificial Sequence
  synthetic [barcode part1]
gttgtaactgtccact

SEQ ID NO: 43846 - DNA, 16 bp, Artificial Sequence
  synthetic [barcode part1]
aagtgattgcgaatcg

SEQ ID NO: 43847 - DNA, 16 bp, Artificial Sequence
  synthetic [barcode part1]
tggacagttgtggcag

SEQ ID NO: 43848 - DNA, 16 bp, Artificial Sequence
  synthetic [barcode part1]
agtgttgcgtatacgc

SEQ ID NO: 43849 - DNA, 16 bp, Artificial Sequence
  synthetic [barcode part1]
gacgagattaggtgcc

SEQ ID NO: 43850 - DNA, 16 bp, Artificial Sequence
  synthetic [barcode part1]
agtggacaccttggag

SEQ ID NO: 43851 - DNA, 16 bp, Artificial Sequence
  synthetic [barcode part1]
tataggtagacgacgt

SEQ ID NO: 43852 - DNA, 16 bp, Artificial Sequence
  synthetic [barcode part1]
cgaaccagtcaagtct

SEQ ID NO: 43853 - DNA, 16 bp, Artificial Sequence
  synthetic [barcode part1]
tcggcctcaccttatt

SEQ ID NO: 43854 - DNA, 16 bp, Artificial Sequence
  synthetic [barcode part1]
actaacctcaggatcg

SEQ ID NO: 43855 - DNA, 16 bp, Artificial Sequence
  synthetic [barcode part1]
taccacagttggtcag

SEQ ID NO: 43856 - DNA, 16 bp, Artificial Sequence
  synthetic [barcode part1]
cagacactcgatacgt

SEQ ID NO: 43857 - DNA, 16 bp, Artificial Sequence
  synthetic [barcode part1]
ataactagaccaaggc

SEQ ID NO: 43858 - DNA, 16 bp, Artificial Sequence
  synthetic [barcode part1]
ccgaacgataatagac

SEQ ID NO: 43859 - DNA, 16 bp, Artificial Sequence
  synthetic [barcode part1]
acaatcggttgtacgc

SEQ ID NO: 43860 - DNA, 16 bp, Artificial Sequence
  synthetic [barcode part1]
agagagtgcaactact

SEQ ID NO: 43861 - DNA, 16 bp, Artificial Sequence
  synthetic [barcode part1]
ccagttcgcgattgtc

SEQ ID NO: 43862 - DNA, 16 bp, Artificial Sequence
  synthetic [barcode part1]
aatccgtcgtcactcg

SEQ ID NO: 43863 - DNA, 16 bp, Artificial Sequence
  synthetic [barcode part1]
ttggacggttctatct

SEQ ID NO: 43864 - DNA, 16 bp, Artificial Sequence
  synthetic [barcode part1]
tgcacagttactacct

SEQ ID NO: 43865 - DNA, 16 bp, Artificial Sequence
  synthetic [barcode part1]
tacactgacaccagtg

SEQ ID NO: 43866 - DNA, 16 bp, Artificial Sequence
  synthetic [barcode part1]
cagtaacaggagtatc

SEQ ID NO: 43867 - DNA, 16 bp, Artificial Sequence
  synthetic [barcode part1]
tctccacagtgtagag

SEQ ID NO: 43868 - DNA, 16 bp, Artificial Sequence
  synthetic [barcode part1]
agaccttaggaaggag

SEQ ID NO: 43869 - DNA, 16 bp, Artificial Sequence
  synthetic [barcode part1]
gataatcgagacacgt

SEQ ID NO: 43870 - DNA, 16 bp, Artificial Sequence
  synthetic [barcode part1]
agtcctcctagacacc

SEQ ID NO: 43871 - DNA, 16 bp, Artificial Sequence
  synthetic [barcode part1]
gtcgcacaaggactag

SEQ ID NO: 43872 - DNA, 16 bp, Artificial Sequence
  synthetic [barcode part1]
cgagatccaactggtt

SEQ ID NO: 43873 - DNA, 16 bp, Artificial Sequence
  synthetic [barcode part1]
cacacctcggattacc

SEQ ID NO: 43874 - DNA, 16 bp, Artificial Sequence
  synthetic [barcode part1]
caagtgcgccactctt

SEQ ID NO: 43875 - DNA, 16 bp, Artificial Sequence
  synthetic [barcode part1]
aggattccaagtagac

SEQ ID NO: 43876 - DNA, 16 bp, Artificial Sequence
  synthetic [barcode part1]
tggttctaccacgcgt

SEQ ID NO: 43877 - DNA, 16 bp, Artificial Sequence
  synthetic [barcode part1]
gtgagtcacgtaacct

SEQ ID NO: 43878 - DNA, 16 bp, Artificial Sequence
  synthetic [barcode part1]
tactctgttgcggatt

SEQ ID NO: 43879 - DNA, 16 bp, Artificial Sequence
  synthetic [barcode part1]
acctacaggaataacg

SEQ ID NO: 43880 - DNA, 16 bp, Artificial Sequence
  synthetic [barcode part1]
gtaattgccgattcct

SEQ ID NO: 43881 - DNA, 16 bp, Artificial Sequence
  synthetic [barcode part1]
cagtctctcctgattc

SEQ ID NO: 43882 - DNA, 16 bp, Artificial Sequence
  synthetic [barcode part1]
cctgtaataccgtccg

SEQ ID NO: 43883 - DNA, 16 bp, Artificial Sequence
  synthetic [barcode part1]
tactgaggacaacctc

SEQ ID NO: 43884 - DNA, 16 bp, Artificial Sequence
  synthetic [barcode part1]
cgtgaatagtaagacc

SEQ ID NO: 43885 - DNA, 16 bp, Artificial Sequence
  synthetic [barcode part1]
aggagtcttggagaag

SEQ ID NO: 43886 - DNA, 16 bp, Artificial Sequence
  synthetic [barcode part1]
ttgtagatcgtcgtct

SEQ ID NO: 43887 - DNA, 16 bp, Artificial Sequence
  synthetic [barcode part1]
tactcgttccaagact

SEQ ID NO: 43888 - DNA, 16 bp, Artificial Sequence
  synthetic [barcode part1]
tacgaacagactcgtc

SEQ ID NO: 43889 - DNA, 16 bp, Artificial Sequence
  synthetic [barcode part1]
ccggtctcgttaacgt

SEQ ID NO: 43890 - DNA, 16 bp, Artificial Sequence
  synthetic [barcode part1]
tgagtctacggcagag

SEQ ID NO: 43891 - DNA, 16 bp, Artificial Sequence
  synthetic [barcode part1]
tgttgttgtagttgcc

SEQ ID NO: 43892 - DNA, 16 bp, Artificial Sequence
  synthetic [barcode part1]
tctgaaggagatcctc

SEQ ID NO: 43893 - DNA, 16 bp, Artificial Sequence
  synthetic [barcode part1]
aatacacacgtgccgt

SEQ ID NO: 43894 - DNA, 16 bp, Artificial Sequence
  synthetic [barcode part1]
tagttggatcgcgatc

SEQ ID NO: 43895 - DNA, 16 bp, Artificial Sequence
  synthetic [barcode part1]
tagacctcaggtgttg

SEQ ID NO: 43896 - DNA, 16 bp, Artificial Sequence
  synthetic [barcode part1]
taagacctcctgagac

SEQ ID NO: 43897 - DNA, 16 bp, Artificial Sequence
  synthetic [barcode part1]
gcaagtgccacaacag

SEQ ID NO: 43898 - DNA, 16 bp, Artificial Sequence
  synthetic [barcode part1]
agacgaccgtgaatcg

SEQ ID NO: 43899 - DNA, 16 bp, Artificial Sequence
  synthetic [barcode part1]
tccttcgtattccgtg

SEQ ID NO: 43900 - DNA, 16 bp, Artificial Sequence
  synthetic [barcode part1]
gcggattcaattctct

SEQ ID NO: 43901 - DNA, 16 bp, Artificial Sequence
  synthetic [barcode part1]
acgcgtcgacagtaag

SEQ ID NO: 43902 - DNA, 16 bp, Artificial Sequence
  synthetic [barcode part1]
tcaacagttgtgttcc

SEQ ID NO: 43903 - DNA, 16 bp, Artificial Sequence
  synthetic [barcode part1]
tgcagactactgtctt

SEQ ID NO: 43904 - DNA, 16 bp, Artificial Sequence
  synthetic [barcode part1]
agtcggcacactatac

SEQ ID NO: 43905 - DNA, 16 bp, Artificial Sequence
  synthetic [barcode part1]
acgtatatacgcgcgt

SEQ ID NO: 43906 - DNA, 16 bp, Artificial Sequence
  synthetic [barcode part1]
aatcgaatatcggcag

SEQ ID NO: 43907 - DNA, 16 bp, Artificial Sequence
  synthetic [barcode part1]
actgtgatatccgttc

SEQ ID NO: 43908 - DNA, 16 bp, Artificial Sequence
  synthetic [barcode part1]
tagtgcgcggtgaagt

SEQ ID NO: 43909 - DNA, 16 bp, Artificial Sequence
  synthetic [barcode part1]
tgtacgattgtcactc

SEQ ID NO: 43910 - DNA, 16 bp, Artificial Sequence
  synthetic [barcode part1]
aaggaataggcgcctc

SEQ ID NO: 43911 - DNA, 16 bp, Artificial Sequence
  synthetic [barcode part1]
tgactctgcgtcgact

SEQ ID NO: 43912 - DNA, 16 bp, Artificial Sequence
  synthetic [barcode part1]
gattacagtgccgact

SEQ ID NO: 43913 - DNA, 16 bp, Artificial Sequence
  synthetic [barcode part1]
aggtactgacaaggcc

SEQ ID NO: 43914 - DNA, 16 bp, Artificial Sequence
  synthetic [barcode part1]
tccgacgataggaacg

SEQ ID NO: 43915 - DNA, 16 bp, Artificial Sequence
  synthetic [barcode part1]
aatccagtggcaactc

SEQ ID NO: 43916 - DNA, 16 bp, Artificial Sequence
  synthetic [barcode part1]
tgtggttacacagtcg

SEQ ID NO: 43917 - DNA, 16 bp, Artificial Sequence
  synthetic [barcode part1]
atcgtccacgaactcc

SEQ ID NO: 43918 - DNA, 16 bp, Artificial Sequence
  synthetic [barcode part1]
caggtatattgaggac

SEQ ID NO: 43919 - DNA, 16 bp, Artificial Sequence
  synthetic [barcode part1]
tctgcacaatcgttac

SEQ ID NO: 43920 - DNA, 16 bp, Artificial Sequence
  synthetic [barcode part1]
attcacgactatctcg

SEQ ID NO: 43921 - DNA, 16 bp, Artificial Sequence
  synthetic [barcode part1]
gttggccagaattctg

SEQ ID NO: 43922 - DNA, 16 bp, Artificial Sequence
  synthetic [barcode part1]
tcacctccacactgag

SEQ ID NO: 43923 - DNA, 16 bp, Artificial Sequence
  synthetic [barcode part1]
taagactgactccggt

SEQ ID NO: 43924 - DNA, 16 bp, Artificial Sequence
  synthetic [barcode part1]
acggtagtggactcag

SEQ ID NO: 43925 - DNA, 16 bp, Artificial Sequence
  synthetic [barcode part1]
cagttagtagtgtcgc

SEQ ID NO: 43926 - DNA, 16 bp, Artificial Sequence
  synthetic [barcode part1]
gcagtgtcacaacgtt

SEQ ID NO: 43927 - DNA, 16 bp, Artificial Sequence
  synthetic [barcode part1]
cacggtccttcgttag

SEQ ID NO: 43928 - DNA, 16 bp, Artificial Sequence
  synthetic [barcode part1]
tacggatcgtcacctc

SEQ ID NO: 43929 - DNA, 16 bp, Artificial Sequence
  synthetic [barcode part1]
acacggtattggcact

SEQ ID NO: 43930 - DNA, 16 bp, Artificial Sequence
  synthetic [barcode part1]
tcttcgaacgtgttgt

SEQ ID NO: 43931 - DNA, 16 bp, Artificial Sequence
  synthetic [barcode part1]
ttgacgaccacgttcc

SEQ ID NO: 43932 - DNA, 16 bp, Artificial Sequence
  synthetic [barcode part1]
gtgtgcaagaaggagt

SEQ ID NO: 43933 - DNA, 16 bp, Artificial Sequence
  synthetic [barcode part1]
gtgcagaagacacaag

SEQ ID NO: 43934 - DNA, 16 bp, Artificial Sequence
  synthetic [barcode part1]
tagaggcactcggtag

SEQ ID NO: 43935 - DNA, 16 bp, Artificial Sequence
  synthetic [barcode part1]
acctggacagatacct

SEQ ID NO: 43936 - DNA, 16 bp, Artificial Sequence
  synthetic [barcode part1]
tcacgtattggcctcg

SEQ ID NO: 43937 - DNA, 16 bp, Artificial Sequence
  synthetic [barcode part1]
ttaatacgagagaccg

SEQ ID NO: 43938 - DNA, 16 bp, Artificial Sequence
  synthetic [barcode part1]
tggaggaaccgtgtac

SEQ ID NO: 43939 - DNA, 16 bp, Artificial Sequence
  synthetic [barcode part1]
taccaggtctgtgcct

SEQ ID NO: 43940 - DNA, 16 bp, Artificial Sequence
  synthetic [barcode part1]
attgtcgcacgtctcg

SEQ ID NO: 43941 - DNA, 16 bp, Artificial Sequence
  synthetic [barcode part1]
tctaccgtgtaccgac

SEQ ID NO: 43942 - DNA, 16 bp, Artificial Sequence
  synthetic [barcode part1]
ttatccggagttctgt

SEQ ID NO: 43943 - DNA, 16 bp, Artificial Sequence
  synthetic [barcode part1]
cgtgacacagaacctt

SEQ ID NO: 43944 - DNA, 16 bp, Artificial Sequence
  synthetic [barcode part1]
ttagaatctcacctgc

SEQ ID NO: 43945 - DNA, 16 bp, Artificial Sequence
  synthetic [barcode part1]
gccgtcacgtatcttg

SEQ ID NO: 43946 - DNA, 16 bp, Artificial Sequence
  synthetic [barcode part1]
aatcctgattcactcg

SEQ ID NO: 43947 - DNA, 16 bp, Artificial Sequence
  synthetic [barcode part1]
tataacaaggcagacc

SEQ ID NO: 43948 - DNA, 16 bp, Artificial Sequence
  synthetic [barcode part1]
tgcggcaagtagacac

SEQ ID NO: 43949 - DNA, 16 bp, Artificial Sequence
  synthetic [barcode part1]
tgcctaataaccttcg

SEQ ID NO: 43950 - DNA, 16 bp, Artificial Sequence
  synthetic [barcode part1]
taggtacgttggaggc

SEQ ID NO: 43951 - DNA, 16 bp, Artificial Sequence
  synthetic [barcode part1]
tctcaccgaacaacag

SEQ ID NO: 43952 - DNA, 16 bp, Artificial Sequence
  synthetic [barcode part1]
cgcgaacagacagtac

SEQ ID NO: 43953 - DNA, 16 bp, Artificial Sequence
  synthetic [barcode part1]
aggtatcagacagtac

SEQ ID NO: 43954 - DNA, 16 bp, Artificial Sequence
  synthetic [barcode part1]
cactggagaaccactt

SEQ ID NO: 43955 - DNA, 16 bp, Artificial Sequence
  synthetic [barcode part1]
acgtggtactgtacgt

SEQ ID NO: 43956 - DNA, 16 bp, Artificial Sequence
  synthetic [barcode part1]
cctaccaggttgtgtc

SEQ ID NO: 43957 - DNA, 16 bp, Artificial Sequence
  synthetic [barcode part1]
caggagacgcacaatc

SEQ ID NO: 43958 - DNA, 16 bp, Artificial Sequence
  synthetic [barcode part1]
tggaacctcttcctct

SEQ ID NO: 43959 - DNA, 16 bp, Artificial Sequence
  synthetic [barcode part1]
taccaacgtgtcaacg

SEQ ID NO: 43960 - DNA, 16 bp, Artificial Sequence
  synthetic [barcode part1]
tgtgtcacaactgcag

SEQ ID NO: 43961 - DNA, 16 bp, Artificial Sequence
  synthetic [barcode part1]
gtgacacaccagttgt

SEQ ID NO: 43962 - DNA, 16 bp, Artificial Sequence
  synthetic [barcode part1]
cctatcggtacgactc

SEQ ID NO: 43963 - DNA, 16 bp, Artificial Sequence
  synthetic [barcode part1]
tgaaccacagtccaac

SEQ ID NO: 43964 - DNA, 16 bp, Artificial Sequence
  synthetic [barcode part1]
cagttcagtccagtag

SEQ ID NO: 43965 - DNA, 16 bp, Artificial Sequence
  synthetic [barcode part1]
gaggaacttgtgtggc

SEQ ID NO: 43966 - DNA, 16 bp, Artificial Sequence
  synthetic [barcode part1]
cgcgtaatattggcgt

SEQ ID NO: 43967 - DNA, 16 bp, Artificial Sequence
  synthetic [barcode part1]
caacggttctctgcgt

SEQ ID NO: 43968 - DNA, 16 bp, Artificial Sequence
  synthetic [barcode part1]
taccaacctccgactg

SEQ ID NO: 43969 - DNA, 16 bp, Artificial Sequence
  synthetic [barcode part1]
taacaatcggtctggc

SEQ ID NO: 43970 - DNA, 16 bp, Artificial Sequence
  synthetic [barcode part1]
tcaccgtattcgcgac

SEQ ID NO: 43971 - DNA, 16 bp, Artificial Sequence
  synthetic [barcode part1]
ccaagacgtagacggt

SEQ ID NO: 43972 - DNA, 16 bp, Artificial Sequence
  synthetic [barcode part1]
gcacgtatacgacact

SEQ ID NO: 43973 - DNA, 16 bp, Artificial Sequence
  synthetic [barcode part1]
tagtcgaccaaccaac

SEQ ID NO: 43974 - DNA, 16 bp, Artificial Sequence
  synthetic [barcode part1]
aagagtagtggtccgc

SEQ ID NO: 43975 - DNA, 16 bp, Artificial Sequence
  synthetic [barcode part1]
tacgcaaccgttattc

SEQ ID NO: 43976 - DNA, 16 bp, Artificial Sequence
  synthetic [barcode part1]
tgcactctagaggtac

SEQ ID NO: 43977 - DNA, 16 bp, Artificial Sequence
  synthetic [barcode part1]
tctagtcgttgtacgt

SEQ ID NO: 43978 - DNA, 16 bp, Artificial Sequence
  synthetic [barcode part1]
cctaactgtcggcgtt

SEQ ID NO: 43979 - DNA, 16 bp, Artificial Sequence
  synthetic [barcode part1]
ttaacgccgtgatcag

SEQ ID NO: 43980 - DNA, 16 bp, Artificial Sequence
  synthetic [barcode part1]
tcacacacacaaccag

SEQ ID NO: 43981 - DNA, 16 bp, Artificial Sequence
  synthetic [barcode part1]
gtacagtcaaccgtac

SEQ ID NO: 43982 - DNA, 16 bp, Artificial Sequence
  synthetic [barcode part1]
aggtgcagtacaagag

SEQ ID NO: 43983 - DNA, 16 bp, Artificial Sequence
  synthetic [barcode part1]
gttcgtccttattcgc

SEQ ID NO: 43984 - DNA, 16 bp, Artificial Sequence
  synthetic [barcode part1]
gaagtaaccgcaggtc

SEQ ID NO: 43985 - DNA, 16 bp, Artificial Sequence
  synthetic [barcode part1]
caagatagtaaccgtg

SEQ ID NO: 43986 - DNA, 16 bp, Artificial Sequence
  synthetic [barcode part1]
gcacacgattgcaatc

SEQ ID NO: 43987 - DNA, 16 bp, Artificial Sequence
  synthetic [barcode part1]
ccaacgaacgaagatt

SEQ ID NO: 43988 - DNA, 16 bp, Artificial Sequence
  synthetic [barcode part1]
tgtggactacctaggt

SEQ ID NO: 43989 - DNA, 16 bp, Artificial Sequence
  synthetic [barcode part1]
gtgtacacggtatcac

SEQ ID NO: 43990 - DNA, 16 bp, Artificial Sequence
  synthetic [barcode part1]
gacgagatacactggc

SEQ ID NO: 43991 - DNA, 16 bp, Artificial Sequence
  synthetic [barcode part1]
tctccggaccaatatt

SEQ ID NO: 43992 - DNA, 16 bp, Artificial Sequence
  synthetic [barcode part1]
tctggtccttcctaac

SEQ ID NO: 43993 - DNA, 16 bp, Artificial Sequence
  synthetic [barcode part1]
gccaattagtcagtcg

SEQ ID NO: 43994 - DNA, 16 bp, Artificial Sequence
  synthetic [barcode part1]
gttgaggcaaccacag

SEQ ID NO: 43995 - DNA, 16 bp, Artificial Sequence
  synthetic [barcode part1]
aagaggagattccgag

SEQ ID NO: 43996 - DNA, 16 bp, Artificial Sequence
  synthetic [barcode part1]
accggcaagatcagac

SEQ ID NO: 43997 - DNA, 16 bp, Artificial Sequence
  synthetic [barcode part1]
acgaggttcgcaagtg

SEQ ID NO: 43998 - DNA, 16 bp, Artificial Sequence
  synthetic [barcode part1]
aagtgatccttgccag

SEQ ID NO: 43999 - DNA, 16 bp, Artificial Sequence
  synthetic [barcode part1]
gtgaggacggtaatcc

SEQ ID NO: 44000 - DNA, 16 bp, Artificial Sequence
  synthetic [barcode part1]
cgagtcagatccagtt

SEQ ID NO: 44001 - DNA, 16 bp, Artificial Sequence
  synthetic [barcode part1]
attctaccgttggcgc

SEQ ID NO: 44002 - DNA, 16 bp, Artificial Sequence
  synthetic [barcode part1]
gttactccaggacagt

SEQ ID NO: 44003 - DNA, 16 bp, Artificial Sequence
  synthetic [barcode part1]
atcttgcgttcagact

SEQ ID NO: 44004 - DNA, 16 bp, Artificial Sequence
  synthetic [barcode part1]
acacctcttaacggcc

SEQ ID NO: 44005 - DNA, 16 bp, Artificial Sequence
  synthetic [barcode part1]
tgtggtgcctactcgt

SEQ ID NO: 44006 - DNA, 16 bp, Artificial Sequence
  synthetic [barcode part1]
tgagtcgccgatagtt

SEQ ID NO: 44007 - DNA, 16 bp, Artificial Sequence
  synthetic [barcode part1]
aagtaagactctaggc

SEQ ID NO: 44008 - DNA, 16 bp, Artificial Sequence
  synthetic [barcode part1]
attgcgttagtggaag

SEQ ID NO: 44009 - DNA, 16 bp, Artificial Sequence
  synthetic [barcode part1]
gcacaataaggtcaac

SEQ ID NO: 44010 - DNA, 16 bp, Artificial Sequence
  synthetic [barcode part1]
tgatcgttctgcgaag

SEQ ID NO: 44011 - DNA, 16 bp, Artificial Sequence
  synthetic [barcode part1]
acggaagttagatcac

SEQ ID NO: 44012 - DNA, 16 bp, Artificial Sequence
  synthetic [barcode part1]
aatcaacctccggagt

SEQ ID NO: 44013 - DNA, 16 bp, Artificial Sequence
  synthetic [barcode part1]
cgacagtaagacgcgt

SEQ ID NO: 44014 - DNA, 16 bp, Artificial Sequence
  synthetic [barcode part1]
gcgttataggccttag

SEQ ID NO: 44015 - DNA, 16 bp, Artificial Sequence
  synthetic [barcode part1]
tacacaggtccagatc

SEQ ID NO: 44016 - DNA, 16 bp, Artificial Sequence
  synthetic [barcode part1]
ttgcggcctagaattg

SEQ ID NO: 44017 - DNA, 16 bp, Artificial Sequence
  synthetic [barcode part1]
atctgactgtgaagag

SEQ ID NO: 44018 - DNA, 16 bp, Artificial Sequence
  synthetic [barcode part1]
ttcgagaacgcgtatc

SEQ ID NO: 44019 - DNA, 16 bp, Artificial Sequence
  synthetic [barcode part1]
gtccgtgattgccttg

SEQ ID NO: 44020 - DNA, 16 bp, Artificial Sequence
  synthetic [barcode part1]
aactaacgtgccacgt

SEQ ID NO: 44021 - DNA, 16 bp, Artificial Sequence
  synthetic [barcode part1]
aggtcagacgtgtcag

SEQ ID NO: 44022 - DNA, 16 bp, Artificial Sequence
  synthetic [barcode part1]
ataggtctaactcctc

SEQ ID NO: 44023 - DNA, 16 bp, Artificial Sequence
  synthetic [barcode part1]
gcgcaggtctgataag

SEQ ID NO: 44024 - DNA, 16 bp, Artificial Sequence
  synthetic [barcode part1]
tagtgcggaagtaact

SEQ ID NO: 44025 - DNA, 16 bp, Artificial Sequence
  synthetic [barcode part1]
attcttaagaccgcct

SEQ ID NO: 44026 - DNA, 16 bp, Artificial Sequence
  synthetic [barcode part1]
gcgccttggaagtatt

SEQ ID NO: 44027 - DNA, 16 bp, Artificial Sequence
  synthetic [barcode part1]
ttacggttgcgatacg

SEQ ID NO: 44028 - DNA, 16 bp, Artificial Sequence
  synthetic [barcode part1]
taaccgttccgactcg

SEQ ID NO: 44029 - DNA, 16 bp, Artificial Sequence
  synthetic [barcode part1]
tacggacggacttgtt

SEQ ID NO: 44030 - DNA, 16 bp, Artificial Sequence
  synthetic [barcode part1]
tagacacactgttctc

SEQ ID NO: 44031 - DNA, 16 bp, Artificial Sequence
  synthetic [barcode part1]
tcgagtacgttattcc

SEQ ID NO: 44032 - DNA, 16 bp, Artificial Sequence
  synthetic [barcode part1]
ccttaacggaagtcgt

SEQ ID NO: 44033 - DNA, 16 bp, Artificial Sequence
  synthetic [barcode part1]
gaggtgttgacttaag

SEQ ID NO: 44034 - DNA, 16 bp, Artificial Sequence
  synthetic [barcode part1]
gttacgtgatcacacg

SEQ ID NO: 44035 - DNA, 16 bp, Artificial Sequence
  synthetic [barcode part1]
ccgtgcctctaacaac

SEQ ID NO: 44036 - DNA, 16 bp, Artificial Sequence
  synthetic [barcode part1]
aggtctaatctggacc

SEQ ID NO: 44037 - DNA, 16 bp, Artificial Sequence
  synthetic [barcode part1]
tctgcactctctgtac

SEQ ID NO: 44038 - DNA, 16 bp, Artificial Sequence
  synthetic [barcode part1]
agtgccaaggatctct

SEQ ID NO: 44039 - DNA, 16 bp, Artificial Sequence
  synthetic [barcode part1]
atactggttccaccgc

SEQ ID NO: 44040 - DNA, 16 bp, Artificial Sequence
  synthetic [barcode part1]
gaggttggttgagaag

SEQ ID NO: 44041 - DNA, 16 bp, Artificial Sequence
  synthetic [barcode part1]
tgtaattggttgcgcg

SEQ ID NO: 44042 - DNA, 16 bp, Artificial Sequence
  synthetic [barcode part1]
cactaccttcgcagac

SEQ ID NO: 44043 - DNA, 16 bp, Artificial Sequence
  synthetic [barcode part1]
gactatccagatcgtg

SEQ ID NO: 44044 - DNA, 16 bp, Artificial Sequence
  synthetic [barcode part1]
gccagtgacttagatc

SEQ ID NO: 44045 - DNA, 16 bp, Artificial Sequence
  synthetic [barcode part1]
cgtggtgaagtgaacc

SEQ ID NO: 44046 - DNA, 16 bp, Artificial Sequence
  synthetic [barcode part1]
gactacaaggatcggc

SEQ ID NO: 44047 - DNA, 16 bp, Artificial Sequence
  synthetic [barcode part1]
gataggcgcgatactg

SEQ ID NO: 44048 - DNA, 16 bp, Artificial Sequence
  synthetic [barcode part1]
gtgaaggagttgccac

SEQ ID NO: 44049 - DNA, 16 bp, Artificial Sequence
  synthetic [barcode part1]
tgaattgtgcgttcct

SEQ ID NO: 44050 - DNA, 16 bp, Artificial Sequence
  synthetic [barcode part1]
cgaattgaaggtacac

SEQ ID NO: 44051 - DNA, 16 bp, Artificial Sequence
  synthetic [barcode part1]
cgataacggtctagtc

SEQ ID NO: 44052 - DNA, 16 bp, Artificial Sequence
  synthetic [barcode part1]
gaggtagacagtagac

SEQ ID NO: 44053 - DNA, 16 bp, Artificial Sequence
  synthetic [barcode part1]
taaggtcgcgtgtatc

SEQ ID NO: 44054 - DNA, 16 bp, Artificial Sequence
  synthetic [barcode part1]
tcgtcgtatagtggac

SEQ ID NO: 44055 - DNA, 16 bp, Artificial Sequence
  synthetic [barcode part1]
ttaggcgaggttcgtt

SEQ ID NO: 44056 - DNA, 16 bp, Artificial Sequence
  synthetic [barcode part1]
attgaagtgcgtagtg

SEQ ID NO: 44057 - DNA, 16 bp, Artificial Sequence
  synthetic [barcode part1]
tcttcctcgtggtatc

SEQ ID NO: 44058 - DNA, 16 bp, Artificial Sequence
  synthetic [barcode part1]
cgattctcaacacgtt

SEQ ID NO: 44059 - DNA, 16 bp, Artificial Sequence
  synthetic [barcode part1]
ttacgccagtaattcc

SEQ ID NO: 44060 - DNA, 16 bp, Artificial Sequence
  synthetic [barcode part1]
atccagttacgttctg

SEQ ID NO: 44061 - DNA, 16 bp, Artificial Sequence
  synthetic [barcode part1]
cgcgtactaattgacg

SEQ ID NO: 44062 - DNA, 16 bp, Artificial Sequence
  synthetic [barcode part1]
aaggacaagacacggt

SEQ ID NO: 44063 - DNA, 16 bp, Artificial Sequence
  synthetic [barcode part1]
agagaacgccttctgt

SEQ ID NO: 44064 - DNA, 16 bp, Artificial Sequence
  synthetic [barcode part1]
agtacgtactggtgtc

SEQ ID NO: 44065 - DNA, 16 bp, Artificial Sequence
  synthetic [barcode part1]
tgcgcagaagttggac

SEQ ID NO: 44066 - DNA, 16 bp, Artificial Sequence
  synthetic [barcode part1]
agatacaaccggaccg

SEQ ID NO: 44067 - DNA, 16 bp, Artificial Sequence
  synthetic [barcode part1]
aggtagatcgtccact

SEQ ID NO: 44068 - DNA, 16 bp, Artificial Sequence
  synthetic [barcode part1]
cgagattattgtggcc

SEQ ID NO: 44069 - DNA, 16 bp, Artificial Sequence
  synthetic [barcode part1]
gttggcacactccact

SEQ ID NO: 44070 - DNA, 16 bp, Artificial Sequence
  synthetic [barcode part1]
aatcacgaggatcaac

SEQ ID NO: 44071 - DNA, 16 bp, Artificial Sequence
  synthetic [barcode part1]
ccagtagttaccaggt

SEQ ID NO: 44072 - DNA, 16 bp, Artificial Sequence
  synthetic [barcode part1]
ttccttctgcgatacc

SEQ ID NO: 44073 - DNA, 16 bp, Artificial Sequence
  synthetic [barcode part1]
cggcaactcttcacac

SEQ ID NO: 44074 - DNA, 16 bp, Artificial Sequence
  synthetic [barcode part1]
caagtcgcacgagagt

SEQ ID NO: 44075 - DNA, 16 bp, Artificial Sequence
  synthetic [barcode part1]
tcgtctcctggtacag

SEQ ID NO: 44076 - DNA, 16 bp, Artificial Sequence
  synthetic [barcode part1]
acgactaccgacttcc

SEQ ID NO: 44077 - DNA, 16 bp, Artificial Sequence
  synthetic [barcode part1]
cgtcgtgtaactagtg

SEQ ID NO: 44078 - DNA, 16 bp, Artificial Sequence
  synthetic [barcode part1]
tactgaggtaggaatc

SEQ ID NO: 44079 - DNA, 16 bp, Artificial Sequence
  synthetic [barcode part1]
gtgaagagttgagtct

SEQ ID NO: 44080 - DNA, 16 bp, Artificial Sequence
  synthetic [barcode part1]
agtgactgtcactgac

SEQ ID NO: 44081 - DNA, 16 bp, Artificial Sequence
  synthetic [barcode part1]
cagatacctaacgcac

SEQ ID NO: 44082 - DNA, 16 bp, Artificial Sequence
  synthetic [barcode part1]
attctcgaacggtctt

SEQ ID NO: 44083 - DNA, 16 bp, Artificial Sequence
  synthetic [barcode part1]
ccggttgttaaccaag

SEQ ID NO: 44084 - DNA, 16 bp, Artificial Sequence
  synthetic [barcode part1]
tacacggtcgtcacct

SEQ ID NO: 44085 - DNA, 16 bp, Artificial Sequence
  synthetic [barcode part1]
tgcgcgtaactaatcg

SEQ ID NO: 44086 - DNA, 16 bp, Artificial Sequence
  synthetic [barcode part1]
cgtgtgaagacactct

SEQ ID NO: 44087 - DNA, 16 bp, Artificial Sequence
  synthetic [barcode part1]
caccaatctggtctcg

SEQ ID NO: 44088 - DNA, 16 bp, Artificial Sequence
  synthetic [barcode part1]
cctacctgcagtgttg

SEQ ID NO: 44089 - DNA, 16 bp, Artificial Sequence
  synthetic [barcode part1]
aattggaccaccgttg

SEQ ID NO: 44090 - DNA, 16 bp, Artificial Sequence
  synthetic [barcode part1]
agtaccagttggtcac

SEQ ID NO: 44091 - DNA, 16 bp, Artificial Sequence
  synthetic [barcode part1]
tggtaaccgacgattc

SEQ ID NO: 44092 - DNA, 16 bp, Artificial Sequence
  synthetic [barcode part1]
aggttattcgtgcctt

SEQ ID NO: 44093 - DNA, 16 bp, Artificial Sequence
  synthetic [barcode part1]
attatcctgtctaggc

SEQ ID NO: 44094 - DNA, 16 bp, Artificial Sequence
  synthetic [barcode part1]
aggaggcacctagact

SEQ ID NO: 44095 - DNA, 16 bp, Artificial Sequence
  synthetic [barcode part1]
gatagtcttggtgacc

SEQ ID NO: 44096 - DNA, 16 bp, Artificial Sequence
  synthetic [barcode part1]
gtgcgatcgatacact

SEQ ID NO: 44097 - DNA, 16 bp, Artificial Sequence
  synthetic [barcode part1]
cagacagatctgttcg

SEQ ID NO: 44098 - DNA, 16 bp, Artificial Sequence
  synthetic [barcode part1]
gcaattccagatcacg

SEQ ID NO: 44099 - DNA, 16 bp, Artificial Sequence
  synthetic [barcode part1]
ttgccaacaacaaccg

SEQ ID NO: 44100 - DNA, 16 bp, Artificial Sequence
  synthetic [barcode part1]
cgacctgattcctacg

SEQ ID NO: 44101 - DNA, 16 bp, Artificial Sequence
  synthetic [barcode part1]
gtccaataaggatacg

SEQ ID NO: 44102 - DNA, 16 bp, Artificial Sequence
  synthetic [barcode part1]
actgtctgttcgcggt

SEQ ID NO: 44103 - DNA, 16 bp, Artificial Sequence
  synthetic [barcode part1]
cgtcgaatcgcacctt

SEQ ID NO: 44104 - DNA, 16 bp, Artificial Sequence
  synthetic [barcode part1]
actaacctgactggtg

SEQ ID NO: 44105 - DNA, 16 bp, Artificial Sequence
  synthetic [barcode part1]
gacgaacctatagtag

SEQ ID NO: 44106 - DNA, 16 bp, Artificial Sequence
  synthetic [barcode part1]
tgcggcagtctattcc

SEQ ID NO: 44107 - DNA, 16 bp, Artificial Sequence
  synthetic [barcode part1]
tcgactctagactcgc

SEQ ID NO: 44108 - DNA, 16 bp, Artificial Sequence
  synthetic [barcode part1]
caggacctagtactac

SEQ ID NO: 44109 - DNA, 16 bp, Artificial Sequence
  synthetic [barcode part1]
agacttcaggactctg

SEQ ID NO: 44110 - DNA, 16 bp, Artificial Sequence
  synthetic [barcode part1]
tcgattcagtgcactt

SEQ ID NO: 44111 - DNA, 16 bp, Artificial Sequence
  synthetic [barcode part1]
agaatcctcacggtac

SEQ ID NO: 44112 - DNA, 16 bp, Artificial Sequence
  synthetic [barcode part1]
tacaggtgcggtagac

SEQ ID NO: 44113 - DNA, 16 bp, Artificial Sequence
  synthetic [barcode part1]
ttcctctataccacgc

SEQ ID NO: 44114 - DNA, 16 bp, Artificial Sequence
  synthetic [barcode part1]
aacgtgcgcgtcaatt

SEQ ID NO: 44115 - DNA, 16 bp, Artificial Sequence
  synthetic [barcode part1]
ttgtgtcgtggtccgt

SEQ ID NO: 44116 - DNA, 16 bp, Artificial Sequence
  synthetic [barcode part1]
tattgccggcgtgtct

SEQ ID NO: 44117 - DNA, 16 bp, Artificial Sequence
  synthetic [barcode part1]
ttacgcagtatcggtg

SEQ ID NO: 44118 - DNA, 16 bp, Artificial Sequence
  synthetic [barcode part1]
gactgataccgtaacc

SEQ ID NO: 44119 - DNA, 16 bp, Artificial Sequence
  synthetic [barcode part1]
caggactgatcaacct

SEQ ID NO: 44120 - DNA, 16 bp, Artificial Sequence
  synthetic [barcode part1]
gtgttctgccgagtct

SEQ ID NO: 44121 - DNA, 16 bp, Artificial Sequence
  synthetic [barcode part1]
tccaaggattgcggtt

SEQ ID NO: 44122 - DNA, 16 bp, Artificial Sequence
  synthetic [barcode part1]
atctcgagtcagtcag

SEQ ID NO: 44123 - DNA, 16 bp, Artificial Sequence
  synthetic [barcode part1]
tcctctgtaccaatag

SEQ ID NO: 44124 - DNA, 16 bp, Artificial Sequence
  synthetic [barcode part1]
taagtcacagtggcct

SEQ ID NO: 44125 - DNA, 16 bp, Artificial Sequence
  synthetic [barcode part1]
cgtgataggactctac

SEQ ID NO: 44126 - DNA, 16 bp, Artificial Sequence
  synthetic [barcode part1]
tactgtggtcaaccag

SEQ ID NO: 44127 - DNA, 16 bp, Artificial Sequence
  synthetic [barcode part1]
tcaggtgttgcctcgt

SEQ ID NO: 44128 - DNA, 16 bp, Artificial Sequence
  synthetic [barcode part1]
acacacaactggttgc

SEQ ID NO: 44129 - DNA, 16 bp, Artificial Sequence
  synthetic [barcode part1]
cgacaactcgaatcgt

SEQ ID NO: 44130 - DNA, 16 bp, Artificial Sequence
  synthetic [barcode part1]
tacggcgtctactcac

SEQ ID NO: 44131 - DNA, 16 bp, Artificial Sequence
  synthetic [barcode part1]
gcacgacttccaactc

SEQ ID NO: 44132 - DNA, 16 bp, Artificial Sequence
  synthetic [barcode part1]
gaggcaacgaacgttc

SEQ ID NO: 44133 - DNA, 16 bp, Artificial Sequence
  synthetic [barcode part1]
agtcctcaattgtacc

SEQ ID NO: 44134 - DNA, 16 bp, Artificial Sequence
  synthetic [barcode part1]
attgcgaacaacgtcc

SEQ ID NO: 44135 - DNA, 16 bp, Artificial Sequence
  synthetic [barcode part1]
ttcagtcgtaccgatt

SEQ ID NO: 44136 - DNA, 16 bp, Artificial Sequence
  synthetic [barcode part1]
actacttaggttcgtc

SEQ ID NO: 44137 - DNA, 16 bp, Artificial Sequence
  synthetic [barcode part1]
gttcgcctgaataggt

SEQ ID NO: 44138 - DNA, 16 bp, Artificial Sequence
  synthetic [barcode part1]
cgtgcaataggagatt

SEQ ID NO: 44139 - DNA, 16 bp, Artificial Sequence
  synthetic [barcode part1]
tggagacacttaacag

SEQ ID NO: 44140 - DNA, 16 bp, Artificial Sequence
  synthetic [barcode part1]
aagaggcaagtacttc

SEQ ID NO: 44141 - DNA, 16 bp, Artificial Sequence
  synthetic [barcode part1]
cgttactaacgcactt

SEQ ID NO: 44142 - DNA, 16 bp, Artificial Sequence
  synthetic [barcode part1]
tccgttacgtgttagt

SEQ ID NO: 44143 - DNA, 16 bp, Artificial Sequence
  synthetic [barcode part1]
acgtatcagacactcg

SEQ ID NO: 44144 - DNA, 16 bp, Artificial Sequence
  synthetic [barcode part1]
ttaggtgagtagagtc

SEQ ID NO: 44145 - DNA, 16 bp, Artificial Sequence
  synthetic [barcode part1]
gtagattgaccgcact

SEQ ID NO: 44146 - DNA, 16 bp, Artificial Sequence
  synthetic [barcode part1]
taattgtgaaccggag

SEQ ID NO: 44147 - DNA, 16 bp, Artificial Sequence
  synthetic [barcode part1]
gcctaccaagtctcgt

SEQ ID NO: 44148 - DNA, 16 bp, Artificial Sequence
  synthetic [barcode part1]
cggtatacctccagtc

SEQ ID NO: 44149 - DNA, 16 bp, Artificial Sequence
  synthetic [barcode part1]
cagtaggcaagacaag

SEQ ID NO: 44150 - DNA, 16 bp, Artificial Sequence
  synthetic [barcode part1]
actcagattgtggacc

SEQ ID NO: 44151 - DNA, 16 bp, Artificial Sequence
  synthetic [barcode part1]
tgcagttgtgcaactg

SEQ ID NO: 44152 - DNA, 16 bp, Artificial Sequence
  synthetic [barcode part1]
agacgtgtcaacgacg

SEQ ID NO: 44153 - DNA, 16 bp, Artificial Sequence
  synthetic [barcode part1]
attatagtcgtctgcc

SEQ ID NO: 44154 - DNA, 16 bp, Artificial Sequence
  synthetic [barcode part1]
tgagtcggtatctctt

SEQ ID NO: 44155 - DNA, 16 bp, Artificial Sequence
  synthetic [barcode part1]
cctgagaagagtcctt

SEQ ID NO: 44156 - DNA, 16 bp, Artificial Sequence
  synthetic [barcode part1]
caatatagaggcaacc

SEQ ID NO: 44157 - DNA, 16 bp, Artificial Sequence
  synthetic [barcode part1]
taggacctcctctctt

SEQ ID NO: 44158 - DNA, 16 bp, Artificial Sequence
  synthetic [barcode part1]
ttcagttcgaccgtgc

SEQ ID NO: 44159 - DNA, 16 bp, Artificial Sequence
  synthetic [barcode part1]
aacacgtgccgtatac

SEQ ID NO: 44160 - DNA, 16 bp, Artificial Sequence
  synthetic [barcode part1]
gtctccagtaatctac

SEQ ID NO: 44161 - DNA, 16 bp, Artificial Sequence
  synthetic [barcode part1]
tccagagaccgtaact

SEQ ID NO: 44162 - DNA, 16 bp, Artificial Sequence
  synthetic [barcode part1]
gacggatattcgttcg

SEQ ID NO: 44163 - DNA, 16 bp, Artificial Sequence
  synthetic [barcode part1]
gtgtaggcgaagatag

SEQ ID NO: 44164 - DNA, 16 bp, Artificial Sequence
  synthetic [barcode part1]
cagacactgtggactt

SEQ ID NO: 44165 - DNA, 16 bp, Artificial Sequence
  synthetic [barcode part1]
tatagtagacgtcgcc

SEQ ID NO: 44166 - DNA, 16 bp, Artificial Sequence
  synthetic [barcode part1]
agttggcaggaagagt

SEQ ID NO: 44167 - DNA, 16 bp, Artificial Sequence
  synthetic [barcode part1]
gagaccagactgtacg

SEQ ID NO: 44168 - DNA, 16 bp, Artificial Sequence
  synthetic [barcode part1]
gacgccagtattgtac

SEQ ID NO: 44169 - DNA, 16 bp, Artificial Sequence
  synthetic [barcode part1]
tcgtgttacagtctgt

SEQ ID NO: 44170 - DNA, 16 bp, Artificial Sequence
  synthetic [barcode part1]
ttcacgaacgagtctg

SEQ ID NO: 44171 - DNA, 16 bp, Artificial Sequence
  synthetic [barcode part1]
cgtctataacgtcgtt

SEQ ID NO: 44172 - DNA, 16 bp, Artificial Sequence
  synthetic [barcode part1]
gatataccttctcggt

SEQ ID NO: 44173 - DNA, 16 bp, Artificial Sequence
  synthetic [barcode part1]
tgccaagtctagtggt

SEQ ID NO: 44174 - DNA, 16 bp, Artificial Sequence
  synthetic [barcode part1]
cgtcacctatctcact

SEQ ID NO: 44175 - DNA, 16 bp, Artificial Sequence
  synthetic [barcode part1]
gacaagagtgtgactt

SEQ ID NO: 44176 - DNA, 16 bp, Artificial Sequence
  synthetic [barcode part1]
tatcgacgagagattg

SEQ ID NO: 44177 - DNA, 16 bp, Artificial Sequence
  synthetic [barcode part1]
atagattctcttggcc

SEQ ID NO: 44178 - DNA, 16 bp, Artificial Sequence
  synthetic [barcode part1]
atcaaccacgtgtgtg

SEQ ID NO: 44179 - DNA, 16 bp, Artificial Sequence
  synthetic [barcode part1]
tcctggtgtacttaac

SEQ ID NO: 44180 - DNA, 16 bp, Artificial Sequence
  synthetic [barcode part1]
tgcgtagttacgcagt

SEQ ID NO: 44181 - DNA, 16 bp, Artificial Sequence
  synthetic [barcode part1]
tcggtattcaattccg

SEQ ID NO: 44182 - DNA, 16 bp, Artificial Sequence
  synthetic [barcode part1]
ttggacaatctcgttc

SEQ ID NO: 44183 - DNA, 16 bp, Artificial Sequence
  synthetic [barcode part1]
ccagattaccgagttg

SEQ ID NO: 44184 - DNA, 16 bp, Artificial Sequence
  synthetic [barcode part1]
gtacgtacgtacgtac

SEQ ID NO: 44185 - DNA, 16 bp, Artificial Sequence
  synthetic [barcode part1]
cggcactaacaggtag

SEQ ID NO: 44186 - DNA, 16 bp, Artificial Sequence
  synthetic [barcode part1]
cagatacgaagtggcc

SEQ ID NO: 44187 - DNA, 16 bp, Artificial Sequence
  synthetic [barcode part1]
gttgtctggtgaggtt

SEQ ID NO: 44188 - DNA, 16 bp, Artificial Sequence
  synthetic [barcode part1]
atcggtgcggaaggtt

SEQ ID NO: 44189 - DNA, 16 bp, Artificial Sequence
  synthetic [barcode part1]
acaacctctacgtccg

SEQ ID NO: 44190 - DNA, 16 bp, Artificial Sequence
  synthetic [barcode part1]
tggcgtgattgaggac

SEQ ID NO: 44191 - DNA, 16 bp, Artificial Sequence
  synthetic [barcode part1]
agtctgtgtctacgag

SEQ ID NO: 44192 - DNA, 16 bp, Artificial Sequence
  synthetic [barcode part1]
gaaccgttatcttcgt

SEQ ID NO: 44193 - DNA, 16 bp, Artificial Sequence
  synthetic [barcode part1]
acacacgtagtaccgt

SEQ ID NO: 44194 - DNA, 16 bp, Artificial Sequence
  synthetic [barcode part1]
gagagatcttgcaagt

SEQ ID NO: 44195 - DNA, 16 bp, Artificial Sequence
  synthetic [barcode part1]
cgtcaagagtgactct

SEQ ID NO: 44196 - DNA, 16 bp, Artificial Sequence
  synthetic [barcode part1]
tcgatcctcgtgtgac

SEQ ID NO: 44197 - DNA, 16 bp, Artificial Sequence
  synthetic [barcode part1]
tcacgagtaagtccgt

SEQ ID NO: 44198 - DNA, 16 bp, Artificial Sequence
  synthetic [barcode part1]
ttgcacctgagttatc

SEQ ID NO: 44199 - DNA, 16 bp, Artificial Sequence
  synthetic [barcode part1]
ataaggaggaagtgcc

SEQ ID NO: 44200 - DNA, 16 bp, Artificial Sequence
  synthetic [barcode part1]
agttccttgtaggtct

SEQ ID NO: 44201 - DNA, 16 bp, Artificial Sequence
  synthetic [barcode part1]
cgtgtcgaatcggaag

SEQ ID NO: 44202 - DNA, 16 bp, Artificial Sequence
  synthetic [barcode part1]
agttcacgtaacagag

SEQ ID NO: 44203 - DNA, 16 bp, Artificial Sequence
  synthetic [barcode part1]
gcaatcttggatcacg

SEQ ID NO: 44204 - DNA, 16 bp, Artificial Sequence
  synthetic [barcode part1]
gacggttcaacagtct

SEQ ID NO: 44205 - DNA, 16 bp, Artificial Sequence
  synthetic [barcode part1]
ttgaacgccgtcctac

SEQ ID NO: 44206 - DNA, 16 bp, Artificial Sequence
  synthetic [barcode part1]
tctaaggattgaccgc

SEQ ID NO: 44207 - DNA, 16 bp, Artificial Sequence
  synthetic [barcode part1]
actatcgcctctgcag

SEQ ID NO: 44208 - DNA, 16 bp, Artificial Sequence
  synthetic [barcode part1]
gtaggaactggtagtt

SEQ ID NO: 44209 - DNA, 16 bp, Artificial Sequence
  synthetic [barcode part1]
gcacagttgactgtgt

SEQ ID NO: 44210 - DNA, 16 bp, Artificial Sequence
  synthetic [barcode part1]
aactctccggtagagt

SEQ ID NO: 44211 - DNA, 16 bp, Artificial Sequence
  synthetic [barcode part1]
ccacaaggaacgttct

SEQ ID NO: 44212 - DNA, 16 bp, Artificial Sequence
  synthetic [barcode part1]
taagtcgatcactggc

SEQ ID NO: 44213 - DNA, 16 bp, Artificial Sequence
  synthetic [barcode part1]
acagacgcggaacttg

SEQ ID NO: 44214 - DNA, 16 bp, Artificial Sequence
  synthetic [barcode part1]
cgaacgaaggtcctag

SEQ ID NO: 44215 - DNA, 16 bp, Artificial Sequence
  synthetic [barcode part1]
gtggaacgtgagttcg

SEQ ID NO: 44216 - DNA, 16 bp, Artificial Sequence
  synthetic [barcode part1]
tgccgttacggaatac

SEQ ID NO: 44217 - DNA, 16 bp, Artificial Sequence
  synthetic [barcode part1]
acgcaaccacaatcgt

SEQ ID NO: 44218 - DNA, 16 bp, Artificial Sequence
  synthetic [barcode part1]
cagttaggccagttac

SEQ ID NO: 44219 - DNA, 16 bp, Artificial Sequence
  synthetic [barcode part1]
aggacactgtgtcttg

SEQ ID NO: 44220 - DNA, 16 bp, Artificial Sequence
  synthetic [barcode part1]
tgccgtctaggtctgt

SEQ ID NO: 44221 - DNA, 16 bp, Artificial Sequence
  synthetic [barcode part1]
tcgtcctactaaggag

SEQ ID NO: 44222 - DNA, 16 bp, Artificial Sequence
  synthetic [barcode part1]
taatcgcggatcggag

SEQ ID NO: 44223 - DNA, 16 bp, Artificial Sequence
  synthetic [barcode part1]
gtcacttaggtctact

SEQ ID NO: 44224 - DNA, 16 bp, Artificial Sequence
  synthetic [barcode part1]
agatagtcgtgaatcg

SEQ ID NO: 44225 - DNA, 16 bp, Artificial Sequence
  synthetic [barcode part1]
gttcttactgcgttcc

SEQ ID NO: 44226 - DNA, 16 bp, Artificial Sequence
  synthetic [barcode part1]
gcgaccaatatcaacc

SEQ ID NO: 44227 - DNA, 16 bp, Artificial Sequence
  synthetic [barcode part1]
gactaggacttggacg

SEQ ID NO: 44228 - DNA, 16 bp, Artificial Sequence
  synthetic [barcode part1]
tggccacgaactagag

SEQ ID NO: 44229 - DNA, 16 bp, Artificial Sequence
  synthetic [barcode part1]
gtgaatcgcacagttc

SEQ ID NO: 44230 - DNA, 16 bp, Artificial Sequence
  synthetic [barcode part1]
cgcgtaagttcagact

SEQ ID NO: 44231 - DNA, 16 bp, Artificial Sequence
  synthetic [barcode part1]
cactaggacttggtgt

SEQ ID NO: 44232 - DNA, 16 bp, Artificial Sequence
  synthetic [barcode part1]
taaccgtagaccggag

SEQ ID NO: 44233 - DNA, 16 bp, Artificial Sequence
  synthetic [barcode part1]
gaaggtgtagaccacc

SEQ ID NO: 44234 - DNA, 16 bp, Artificial Sequence
  synthetic [barcode part1]
atccaaccgatccaag

SEQ ID NO: 44235 - DNA, 16 bp, Artificial Sequence
  synthetic [barcode part1]
cggatcagaagatact

SEQ ID NO: 44236 - DNA, 16 bp, Artificial Sequence
  synthetic [barcode part1]
agattcggcagttacc

SEQ ID NO: 44237 - DNA, 16 bp, Artificial Sequence
  synthetic [barcode part1]
cacagattgtccgaac

SEQ ID NO: 44238 - DNA, 16 bp, Artificial Sequence
  synthetic [barcode part1]
accggaaccttaatcg

SEQ ID NO: 44239 - DNA, 16 bp, Artificial Sequence
  synthetic [barcode part1]
tactacgatcgaccag

SEQ ID NO: 44240 - DNA, 16 bp, Artificial Sequence
  synthetic [barcode part1]
gcagtgtcagtgttgt

SEQ ID NO: 44241 - DNA, 16 bp, Artificial Sequence
  synthetic [barcode part1]
ttgtgtgaccagtgtg

SEQ ID NO: 44242 - DNA, 16 bp, Artificial Sequence
  synthetic [barcode part1]
caacttgtcacacttg

SEQ ID NO: 44243 - DNA, 16 bp, Artificial Sequence
  synthetic [barcode part1]
ccttacgtggtccaac

SEQ ID NO: 44244 - DNA, 16 bp, Artificial Sequence
  synthetic [barcode part1]
tctcagtatcgcctct

SEQ ID NO: 44245 - DNA, 16 bp, Artificial Sequence
  synthetic [barcode part1]
tgttcgtactcgtcct

SEQ ID NO: 44246 - DNA, 16 bp, Artificial Sequence
  synthetic [barcode part1]
actcgtcaatactgtc

SEQ ID NO: 44247 - DNA, 16 bp, Artificial Sequence
  synthetic [barcode part1]
gaattccgtcgactag

SEQ ID NO: 44248 - DNA, 16 bp, Artificial Sequence
  synthetic [barcode part1]
ataggtcgccacttcc

SEQ ID NO: 44249 - DNA, 16 bp, Artificial Sequence
  synthetic [barcode part1]
aggaaccgaggaattg

SEQ ID NO: 44250 - DNA, 16 bp, Artificial Sequence
  synthetic [barcode part1]
tggtaacaggacgtgc

SEQ ID NO: 44251 - DNA, 16 bp, Artificial Sequence
  synthetic [barcode part1]
attcgacgaccactag

SEQ ID NO: 44252 - DNA, 16 bp, Artificial Sequence
  synthetic [barcode part1]
gagtgttattcacggc

SEQ ID NO: 44253 - DNA, 16 bp, Artificial Sequence
  synthetic [barcode part1]
gtcggtaagtgacggt

SEQ ID NO: 44254 - DNA, 16 bp, Artificial Sequence
  synthetic [barcode part1]
atcggtggcgattgtt

SEQ ID NO: 44255 - DNA, 16 bp, Artificial Sequence
  synthetic [barcode part1]
taaggaggtaccaact

SEQ ID NO: 44256 - DNA, 16 bp, Artificial Sequence
  synthetic [barcode part1]
aactgaactaccaccg

SEQ ID NO: 44257 - DNA, 16 bp, Artificial Sequence
  synthetic [barcode part1]
tgcgcaatacttcgtt

SEQ ID NO: 44258 - DNA, 16 bp, Artificial Sequence
  synthetic [barcode part1]
tcgacagagtgatcct

SEQ ID NO: 44259 - DNA, 16 bp, Artificial Sequence
  synthetic [barcode part1]
cgtagacggcgagatt

SEQ ID NO: 44260 - DNA, 16 bp, Artificial Sequence
  synthetic [barcode part1]
gtacgtacaactgacc

SEQ ID NO: 44261 - DNA, 16 bp, Artificial Sequence
  synthetic [barcode part1]
acacaacaaccttctc

SEQ ID NO: 44262 - DNA, 16 bp, Artificial Sequence
  synthetic [barcode part1]
atatatcgcaaggcag

SEQ ID NO: 44263 - DNA, 16 bp, Artificial Sequence
  synthetic [barcode part1]
tccagaactagttggc

SEQ ID NO: 44264 - DNA, 16 bp, Artificial Sequence
  synthetic [barcode part1]
acgccttccagatcac

SEQ ID NO: 44265 - DNA, 16 bp, Artificial Sequence
  synthetic [barcode part1]
aatacgtcggcgtgtt

SEQ ID NO: 44266 - DNA, 16 bp, Artificial Sequence
  synthetic [barcode part1]
gagtaggcaaggttcc

SEQ ID NO: 44267 - DNA, 16 bp, Artificial Sequence
  synthetic [barcode part1]
tgtaagtccgcctcgt

SEQ ID NO: 44268 - DNA, 16 bp, Artificial Sequence
  synthetic [barcode part1]
gcgccttccagattgt

SEQ ID NO: 44269 - DNA, 16 bp, Artificial Sequence
  synthetic [barcode part1]
aggttaacgatacacg

SEQ ID NO: 44270 - DNA, 16 bp, Artificial Sequence
  synthetic [barcode part1]
tctccttagagtctcc

SEQ ID NO: 44271 - DNA, 16 bp, Artificial Sequence
  synthetic [barcode part1]
ataacgccggttaacc

SEQ ID NO: 44272 - DNA, 16 bp, Artificial Sequence
  synthetic [barcode part1]
gagttcacgaactcac

SEQ ID NO: 44273 - DNA, 16 bp, Artificial Sequence
  synthetic [barcode part1]
cgcctgtcctagagtt

SEQ ID NO: 44274 - DNA, 16 bp, Artificial Sequence
  synthetic [barcode part1]
agtctctcgcagacct

SEQ ID NO: 44275 - DNA, 16 bp, Artificial Sequence
  synthetic [barcode part1]
cctactggtgtctgac

SEQ ID NO: 44276 - DNA, 16 bp, Artificial Sequence
  synthetic [barcode part1]
tcacagaataaggcac

SEQ ID NO: 44277 - DNA, 16 bp, Artificial Sequence
  synthetic [barcode part1]
cgacaattccttgcgc

SEQ ID NO: 44278 - DNA, 16 bp, Artificial Sequence
  synthetic [barcode part1]
actcaccttacggtgc

SEQ ID NO: 44279 - DNA, 16 bp, Artificial Sequence
  synthetic [barcode part1]
tactggtccggtcttg

SEQ ID NO: 44280 - DNA, 16 bp, Artificial Sequence
  synthetic [barcode part1]
tgcaactctggatacg

SEQ ID NO: 44281 - DNA, 16 bp, Artificial Sequence
  synthetic [barcode part1]
gcactcttaacgattc

SEQ ID NO: 44282 - DNA, 16 bp, Artificial Sequence
  synthetic [barcode part1]
ttggcgagttcttgtt

SEQ ID NO: 44283 - DNA, 16 bp, Artificial Sequence
  synthetic [barcode part1]
gtgtcctgacctagtc

SEQ ID NO: 44284 - DNA, 16 bp, Artificial Sequence
  synthetic [barcode part1]
gaaggtgtattagacc

SEQ ID NO: 44285 - DNA, 16 bp, Artificial Sequence
  synthetic [barcode part1]
ataatctccacgttcg

SEQ ID NO: 44286 - DNA, 16 bp, Artificial Sequence
  synthetic [barcode part1]
cgacctgaggtgtaag

SEQ ID NO: 44287 - DNA, 16 bp, Artificial Sequence
  synthetic [barcode part1]
gtcttgtgtccaagtt

SEQ ID NO: 44288 - DNA, 16 bp, Artificial Sequence
  synthetic [barcode part1]
tacgttcgcaggaact

SEQ ID NO: 44289 - DNA, 16 bp, Artificial Sequence
  synthetic [barcode part1]
gattcgtacctcgtcg

SEQ ID NO: 44290 - DNA, 16 bp, Artificial Sequence
  synthetic [barcode part1]
gcgtaagtctggtgag

SEQ ID NO: 44291 - DNA, 16 bp, Artificial Sequence
  synthetic [barcode part1]
tgaaccgtcggcaatt

SEQ ID NO: 44292 - DNA, 16 bp, Artificial Sequence
  synthetic [barcode part1]
ttgaggcaggcaggtt

SEQ ID NO: 44293 - DNA, 16 bp, Artificial Sequence
  synthetic [barcode part1]
tgtggagaattcggcg

SEQ ID NO: 44294 - DNA, 16 bp, Artificial Sequence
  synthetic [barcode part1]
caagatctgtgcgtac

SEQ ID NO: 44295 - DNA, 16 bp, Artificial Sequence
  synthetic [barcode part1]
aatctccggccacact

SEQ ID NO: 44296 - DNA, 16 bp, Artificial Sequence
  synthetic [barcode part1]
aagtaactgcgccgag

SEQ ID NO: 44297 - DNA, 16 bp, Artificial Sequence
  synthetic [barcode part1]
gttggtgtccaatctt

SEQ ID NO: 44298 - DNA, 16 bp, Artificial Sequence
  synthetic [barcode part1]
actctgattctctccg

SEQ ID NO: 44299 - DNA, 16 bp, Artificial Sequence
  synthetic [barcode part1]
cggtgtctcacaatag

SEQ ID NO: 44300 - DNA, 16 bp, Artificial Sequence
  synthetic [barcode part1]
gaatcacacctctgcc

SEQ ID NO: 44301 - DNA, 16 bp, Artificial Sequence
  synthetic [barcode part1]
ttccgcgtataggagt

SEQ ID NO: 44302 - DNA, 16 bp, Artificial Sequence
  synthetic [barcode part1]
gcactagactggaggt

SEQ ID NO: 44303 - DNA, 16 bp, Artificial Sequence
  synthetic [barcode part1]
gacttggcgatagtct

SEQ ID NO: 44304 - DNA, 16 bp, Artificial Sequence
  synthetic [barcode part1]
tgtgtgtacacgtgtg

SEQ ID NO: 44305 - DNA, 16 bp, Artificial Sequence
  synthetic [barcode part1]
gacgagatcaacgtgc

SEQ ID NO: 44306 - DNA, 16 bp, Artificial Sequence
  synthetic [barcode part1]
gtactgtgacgttgtg

SEQ ID NO: 44307 - DNA, 16 bp, Artificial Sequence
  synthetic [barcode part1]
ttggtccgagtgttcc

SEQ ID NO: 44308 - DNA, 16 bp, Artificial Sequence
  synthetic [barcode part1]
tccgtgttgacttaac

SEQ ID NO: 44309 - DNA, 16 bp, Artificial Sequence
  synthetic [barcode part1]
taacggtacgcctctc

SEQ ID NO: 44310 - DNA, 16 bp, Artificial Sequence
  synthetic [barcode part1]
tcgccacctataagtt

SEQ ID NO: 44311 - DNA, 16 bp, Artificial Sequence
  synthetic [barcode part1]
cagaccaatcgtcagt

SEQ ID NO: 44312 - DNA, 16 bp, Artificial Sequence
  synthetic [barcode part1]
tgccggaagattatcc

SEQ ID NO: 44313 - DNA, 16 bp, Artificial Sequence
  synthetic [barcode part1]
tcgaggagattgcacg

SEQ ID NO: 44314 - DNA, 16 bp, Artificial Sequence
  synthetic [barcode part1]
gaaggcacacttctac

SEQ ID NO: 44315 - DNA, 16 bp, Artificial Sequence
  synthetic [barcode part1]
gttagattgtctccgt

SEQ ID NO: 44316 - DNA, 16 bp, Artificial Sequence
  synthetic [barcode part1]
ccttcagtgtggttgc

SEQ ID NO: 44317 - DNA, 16 bp, Artificial Sequence
  synthetic [barcode part1]
tgtgcgacttgattct

SEQ ID NO: 44318 - DNA, 16 bp, Artificial Sequence
  synthetic [barcode part1]
agaagtgtgccagatt

SEQ ID NO: 44319 - DNA, 16 bp, Artificial Sequence
  synthetic [barcode part1]
tctaagaggaggaggt

SEQ ID NO: 44320 - DNA, 16 bp, Artificial Sequence
  synthetic [barcode part1]
gttggactcgtgcctt

SEQ ID NO: 44321 - DNA, 16 bp, Artificial Sequence
  synthetic [barcode part1]
tctattgtggcggaac

SEQ ID NO: 44322 - DNA, 16 bp, Artificial Sequence
  synthetic [barcode part1]
gtcacttgtccgtggt

SEQ ID NO: 44323 - DNA, 16 bp, Artificial Sequence
  synthetic [barcode part1]
gacacgtaccaacgtt

SEQ ID NO: 44324 - DNA, 16 bp, Artificial Sequence
  synthetic [barcode part1]
agttgtacgcagtcgt

SEQ ID NO: 44325 - DNA, 16 bp, Artificial Sequence
  synthetic [barcode part1]
acagacggtaacgtcg

SEQ ID NO: 44326 - DNA, 16 bp, Artificial Sequence
  synthetic [barcode part1]
ccttatagacttggtc

SEQ ID NO: 44327 - DNA, 16 bp, Artificial Sequence
  synthetic [barcode part1]
cgtgcactgatactag

SEQ ID NO: 44328 - DNA, 16 bp, Artificial Sequence
  synthetic [barcode part1]
acgaatattcaggacg

SEQ ID NO: 44329 - DNA, 16 bp, Artificial Sequence
  synthetic [barcode part1]
caacgtagaggtgacc

SEQ ID NO: 44330 - DNA, 16 bp, Artificial Sequence
  synthetic [barcode part1]
gccgaataagttgcct

SEQ ID NO: 44331 - DNA, 16 bp, Artificial Sequence
  synthetic [barcode part1]
tagaagacctcttggc

SEQ ID NO: 44332 - DNA, 16 bp, Artificial Sequence
  synthetic [barcode part1]
tggatcgtgacgactt

SEQ ID NO: 44333 - DNA, 16 bp, Artificial Sequence
  synthetic [barcode part1]
gacagtgacagactcg

SEQ ID NO: 44334 - DNA, 16 bp, Artificial Sequence
  synthetic [barcode part1]
tgattcgagtacgaag

SEQ ID NO: 44335 - DNA, 16 bp, Artificial Sequence
  synthetic [barcode part1]
atccttaagtgacctc

SEQ ID NO: 44336 - DNA, 16 bp, Artificial Sequence
  synthetic [barcode part1]
ccgcgtaggttagaag

SEQ ID NO: 44337 - DNA, 16 bp, Artificial Sequence
  synthetic [barcode part1]
tgcaccgttccaatcg

SEQ ID NO: 44338 - DNA, 16 bp, Artificial Sequence
  synthetic [barcode part1]
gatctctgcacaactt

SEQ ID NO: 44339 - DNA, 16 bp, Artificial Sequence
  synthetic [barcode part1]
ccactcaagtactatc

SEQ ID NO: 44340 - DNA, 16 bp, Artificial Sequence
  synthetic [barcode part1]
tctctaagaccaggac

SEQ ID NO: 44341 - DNA, 16 bp, Artificial Sequence
  synthetic [barcode part1]
gattattacctctgcg

SEQ ID NO: 44342 - DNA, 16 bp, Artificial Sequence
  synthetic [barcode part1]
caagtcaatcgagtcc

SEQ ID NO: 44343 - DNA, 16 bp, Artificial Sequence
  synthetic [barcode part1]
agtcttgacctacttg

SEQ ID NO: 44344 - DNA, 16 bp, Artificial Sequence
  synthetic [barcode part1]
cggaagatatacgatc

SEQ ID NO: 44345 - DNA, 16 bp, Artificial Sequence
  synthetic [barcode part1]
caccgaacctgatagt

SEQ ID NO: 44346 - DNA, 16 bp, Artificial Sequence
  synthetic [barcode part1]
ccacgaacttagtctt

SEQ ID NO: 44347 - DNA, 16 bp, Artificial Sequence
  synthetic [barcode part1]
acgtaggatcttcacg

SEQ ID NO: 44348 - DNA, 16 bp, Artificial Sequence
  synthetic [barcode part1]
acacaactgtgactgc

SEQ ID NO: 44349 - DNA, 16 bp, Artificial Sequence
  synthetic [barcode part1]
gattcacctgtcttag

SEQ ID NO: 44350 - DNA, 16 bp, Artificial Sequence
  synthetic [barcode part1]
atattgatcggacgcc

SEQ ID NO: 44351 - DNA, 16 bp, Artificial Sequence
  synthetic [barcode part1]
atagtcgttcctcggc

SEQ ID NO: 44352 - DNA, 16 bp, Artificial Sequence
  synthetic [barcode part1]
acactccgatcgtcac

SEQ ID NO: 44353 - DNA, 16 bp, Artificial Sequence
  synthetic [barcode part1]
cctgatcaccacgtac

SEQ ID NO: 44354 - DNA, 16 bp, Artificial Sequence
  synthetic [barcode part1]
tcgccacttacttcgt

SEQ ID NO: 44355 - DNA, 16 bp, Artificial Sequence
  synthetic [barcode part1]
tcttccgattcggacg

SEQ ID NO: 44356 - DNA, 16 bp, Artificial Sequence
  synthetic [barcode part1]
attcggaacctcgtcc

SEQ ID NO: 44357 - DNA, 16 bp, Artificial Sequence
  synthetic [barcode part1]
cgtcgaagaactacct

SEQ ID NO: 44358 - DNA, 16 bp, Artificial Sequence
  synthetic [barcode part1]
ttgactccaggtccgt

SEQ ID NO: 44359 - DNA, 16 bp, Artificial Sequence
  synthetic [barcode part1]
ttccgcgaattatcgt

SEQ ID NO: 44360 - DNA, 16 bp, Artificial Sequence
  synthetic [barcode part1]
tcttgagttgtctacg

SEQ ID NO: 44361 - DNA, 16 bp, Artificial Sequence
  synthetic [barcode part1]
caccgactagtatacg

SEQ ID NO: 44362 - DNA, 16 bp, Artificial Sequence
  synthetic [barcode part1]
acgttggttctcagtt

SEQ ID NO: 44363 - DNA, 16 bp, Artificial Sequence
  synthetic [barcode part1]
gtaactcttgcacttg

SEQ ID NO: 44364 - DNA, 16 bp, Artificial Sequence
  synthetic [barcode part1]
acagtactgcaacacc

SEQ ID NO: 44365 - DNA, 16 bp, Artificial Sequence
  synthetic [barcode part1]
actagtaaggcgtcct

SEQ ID NO: 44366 - DNA, 16 bp, Artificial Sequence
  synthetic [barcode part1]
gaagtctcgcctgttc

SEQ ID NO: 44367 - DNA, 16 bp, Artificial Sequence
  synthetic [barcode part1]
ccaattgtagtcgacg

SEQ ID NO: 44368 - DNA, 16 bp, Artificial Sequence
  synthetic [barcode part1]
tctatcttaggactcg

SEQ ID NO: 44369 - DNA, 16 bp, Artificial Sequence
  synthetic [barcode part1]
gagtgacgcgcaattg

SEQ ID NO: 44370 - DNA, 16 bp, Artificial Sequence
  synthetic [barcode part1]
taactcgtgagttgcg

SEQ ID NO: 44371 - DNA, 16 bp, Artificial Sequence
  synthetic [barcode part1]
acagaagaaggcgtgt

SEQ ID NO: 44372 - DNA, 16 bp, Artificial Sequence
  synthetic [barcode part1]
tgactagtcagtcgac

SEQ ID NO: 44373 - DNA, 16 bp, Artificial Sequence
  synthetic [barcode part1]
gattctggacgttgtg

SEQ ID NO: 44374 - DNA, 16 bp, Artificial Sequence
  synthetic [barcode part1]
cggactcctgttctag

SEQ ID NO: 44375 - DNA, 16 bp, Artificial Sequence
  synthetic [barcode part1]
cgaaccacgtaggagt

SEQ ID NO: 44376 - DNA, 16 bp, Artificial Sequence
  synthetic [barcode part1]
aacagaggcgtggtct

SEQ ID NO: 44377 - DNA, 16 bp, Artificial Sequence
  synthetic [barcode part1]
ttcaggacttcaggac

SEQ ID NO: 44378 - DNA, 16 bp, Artificial Sequence
  synthetic [barcode part1]
gttggatacgacttgc

SEQ ID NO: 44379 - DNA, 16 bp, Artificial Sequence
  synthetic [barcode part1]
caatacgactgcctcc

SEQ ID NO: 44380 - DNA, 16 bp, Artificial Sequence
  synthetic [barcode part1]
tgttgtgactgtgacg

SEQ ID NO: 44381 - DNA, 16 bp, Artificial Sequence
  synthetic [barcode part1]
acctaacgcactcctg

SEQ ID NO: 44382 - DNA, 16 bp, Artificial Sequence
  synthetic [barcode part1]
tcaacttgagtcaggc

SEQ ID NO: 44383 - DNA, 16 bp, Artificial Sequence
  synthetic [barcode part1]
agtgtatctggaaggt

SEQ ID NO: 44384 - DNA, 16 bp, Artificial Sequence
  synthetic [barcode part1]
tagatccactctatcg

SEQ ID NO: 44385 - DNA, 16 bp, Artificial Sequence
  synthetic [barcode part1]
gcacgatcgatacgtt

SEQ ID NO: 44386 - DNA, 16 bp, Artificial Sequence
  synthetic [barcode part1]
tccgtatcggtgacct

SEQ ID NO: 44387 - DNA, 16 bp, Artificial Sequence
  synthetic [barcode part1]
actccaaggagtcttg

SEQ ID NO: 44388 - DNA, 16 bp, Artificial Sequence
  synthetic [barcode part1]
aagactcgaatctcgc

SEQ ID NO: 44389 - DNA, 16 bp, Artificial Sequence
  synthetic [barcode part1]
tgcaagtaagtaacgc

SEQ ID NO: 44390 - DNA, 16 bp, Artificial Sequence
  synthetic [barcode part1]
tggacgatcgcgatag

SEQ ID NO: 44391 - DNA, 16 bp, Artificial Sequence
  synthetic [barcode part1]
tcgatacaacttcctg

SEQ ID NO: 44392 - DNA, 16 bp, Artificial Sequence
  synthetic [barcode part1]
cgtgcggcgtcttatt

SEQ ID NO: 44393 - DNA, 16 bp, Artificial Sequence
  synthetic [barcode part1]
acgagagatcagattc

SEQ ID NO: 44394 - DNA, 16 bp, Artificial Sequence
  synthetic [barcode part1]
tatcttgcgagacgac

SEQ ID NO: 44395 - DNA, 16 bp, Artificial Sequence
  synthetic [barcode part1]
tcttctagagtgtctg

SEQ ID NO: 44396 - DNA, 16 bp, Artificial Sequence
  synthetic [barcode part1]
gtgtatcgagttagag

SEQ ID NO: 44397 - DNA, 16 bp, Artificial Sequence
  synthetic [barcode part1]
tgtgtgtgactaaccg

SEQ ID NO: 44398 - DNA, 16 bp, Artificial Sequence
  synthetic [barcode part1]
gtcctgtctgttgttc

SEQ ID NO: 44399 - DNA, 16 bp, Artificial Sequence
  synthetic [barcode part1]
acgattgccgaccttc

SEQ ID NO: 44400 - DNA, 16 bp, Artificial Sequence
  synthetic [barcode part1]
cggatatcctctggtc

SEQ ID NO: 44401 - DNA, 16 bp, Artificial Sequence
  synthetic [barcode part1]
agagttctccaagacc

SEQ ID NO: 44402 - DNA, 16 bp, Artificial Sequence
  synthetic [barcode part1]
gagagactatcctacc

SEQ ID NO: 44403 - DNA, 16 bp, Artificial Sequence
  synthetic [barcode part1]
ttcctgaccaaggagt

SEQ ID NO: 44404 - DNA, 16 bp, Artificial Sequence
  synthetic [barcode part1]
attcgccgtaatactc

SEQ ID NO: 44405 - DNA, 16 bp, Artificial Sequence
  synthetic [barcode part1]
tacgtcacacaaccag

SEQ ID NO: 44406 - DNA, 16 bp, Artificial Sequence
  synthetic [barcode part1]
gccgacgtaccttgtt

SEQ ID NO: 44407 - DNA, 16 bp, Artificial Sequence
  synthetic [barcode part1]
tcagtaggaactgtcc

SEQ ID NO: 44408 - DNA, 16 bp, Artificial Sequence
  synthetic [barcode part1]
aatctcgttgttcacg

SEQ ID NO: 44409 - DNA, 16 bp, Artificial Sequence
  synthetic [barcode part1]
tcctaactcggatact

SEQ ID NO: 44410 - DNA, 16 bp, Artificial Sequence
  synthetic [barcode part1]
aatccttccaggcacc

SEQ ID NO: 44411 - DNA, 16 bp, Artificial Sequence
  synthetic [barcode part1]
tcaccgttggagtaac

SEQ ID NO: 44412 - DNA, 16 bp, Artificial Sequence
  synthetic [barcode part1]
cagtaatcggcgactt

SEQ ID NO: 44413 - DNA, 16 bp, Artificial Sequence
  synthetic [barcode part1]
gtgatcggttgtacgt

SEQ ID NO: 44414 - DNA, 16 bp, Artificial Sequence
  synthetic [barcode part1]
acgccagaggaattgc

SEQ ID NO: 44415 - DNA, 16 bp, Artificial Sequence
  synthetic [barcode part1]
actgacaattcttcgc

SEQ ID NO: 44416 - DNA, 16 bp, Artificial Sequence
  synthetic [barcode part1]
acggtcggttagtatc

SEQ ID NO: 44417 - DNA, 16 bp, Artificial Sequence
  synthetic [barcode part1]
taggaggacacactgc

SEQ ID NO: 44418 - DNA, 16 bp, Artificial Sequence
  synthetic [barcode part1]
taagaggtcttggcct

SEQ ID NO: 44419 - DNA, 16 bp, Artificial Sequence
  synthetic [barcode part1]
aacgcagagattgccg

SEQ ID NO: 44420 - DNA, 16 bp, Artificial Sequence
  synthetic [barcode part1]
gccgttcgcgaattct

SEQ ID NO: 44421 - DNA, 16 bp, Artificial Sequence
  synthetic [barcode part1]
gaccaatcttcggaac

SEQ ID NO: 44422 - DNA, 16 bp, Artificial Sequence
  synthetic [barcode part1]
aataggtacaggcgag

SEQ ID NO: 44423 - DNA, 16 bp, Artificial Sequence
  synthetic [barcode part1]
acaaggaccagaccgt

SEQ ID NO: 44424 - DNA, 16 bp, Artificial Sequence
  synthetic [barcode part1]
atcaacgtgccagtac

SEQ ID NO: 44425 - DNA, 16 bp, Artificial Sequence
  synthetic [barcode part1]
tcgtatccttacgcct

SEQ ID NO: 44426 - DNA, 16 bp, Artificial Sequence
  synthetic [barcode part1]
ttggtagtacttctgc

SEQ ID NO: 44427 - DNA, 16 bp, Artificial Sequence
  synthetic [barcode part1]
attagaggagagaccg

SEQ ID NO: 44428 - DNA, 16 bp, Artificial Sequence
  synthetic [barcode part1]
agatctaggcgtgtct

SEQ ID NO: 44429 - DNA, 16 bp, Artificial Sequence
  synthetic [barcode part1]
gacgaacgtgaacaag

SEQ ID NO: 44430 - DNA, 16 bp, Artificial Sequence
  synthetic [barcode part1]
agtgtgtctagagaac

SEQ ID NO: 44431 - DNA, 16 bp, Artificial Sequence
  synthetic [barcode part1]
aactgattggccgact

SEQ ID NO: 44432 - DNA, 16 bp, Artificial Sequence
  synthetic [barcode part1]
agaatctcctgtctgt

SEQ ID NO: 44433 - DNA, 16 bp, Artificial Sequence
  synthetic [barcode part1]
aaccaggcggattcag

SEQ ID NO: 44434 - DNA, 16 bp, Artificial Sequence
  synthetic [barcode part1]
tcaggacactcgtcct

SEQ ID NO: 44435 - DNA, 16 bp, Artificial Sequence
  synthetic [barcode part1]
tcgcacttcactaggc

SEQ ID NO: 44436 - DNA, 16 bp, Artificial Sequence
  synthetic [barcode part1]
tcactcctataggttg

SEQ ID NO: 44437 - DNA, 16 bp, Artificial Sequence
  synthetic [barcode part1]
taggcgtatacggtct

SEQ ID NO: 44438 - DNA, 16 bp, Artificial Sequence
  synthetic [barcode part1]
gaagtcgtaaccttcg

SEQ ID NO: 44439 - DNA, 16 bp, Artificial Sequence
  synthetic [barcode part1]
tccgttctaagatctg

SEQ ID NO: 44440 - DNA, 16 bp, Artificial Sequence
  synthetic [barcode part1]
acgccgagaagtagtc

SEQ ID NO: 44441 - DNA, 16 bp, Artificial Sequence
  synthetic [barcode part1]
gataatcctggcggtt

SEQ ID NO: 44442 - DNA, 16 bp, Artificial Sequence
  synthetic [barcode part1]
aaggacaccacacctt

SEQ ID NO: 44443 - DNA, 16 bp, Artificial Sequence
  synthetic [barcode part1]
tgccgaattgtacctt

SEQ ID NO: 44444 - DNA, 16 bp, Artificial Sequence
  synthetic [barcode part1]
agtcacgccgagaagt

SEQ ID NO: 44445 - DNA, 16 bp, Artificial Sequence
  synthetic [barcode part1]
gtcggtaagtgcactt

SEQ ID NO: 44446 - DNA, 16 bp, Artificial Sequence
  synthetic [barcode part1]
tccactggtgtagtcc

SEQ ID NO: 44447 - DNA, 16 bp, Artificial Sequence
  synthetic [barcode part1]
gtcgatatcgtgcaac

SEQ ID NO: 44448 - DNA, 16 bp, Artificial Sequence
  synthetic [barcode part1]
gttgtcttgtccaagt

SEQ ID NO: 44449 - DNA, 16 bp, Artificial Sequence
  synthetic [barcode part1]
cacacaggcaatcact

SEQ ID NO: 44450 - DNA, 16 bp, Artificial Sequence
  synthetic [barcode part1]
tcctattggtgtctag

SEQ ID NO: 44451 - DNA, 16 bp, Artificial Sequence
  synthetic [barcode part1]
cgtggatcgtcgttct

SEQ ID NO: 44452 - DNA, 16 bp, Artificial Sequence
  synthetic [barcode part1]
ccaacagttcagtggt

SEQ ID NO: 44453 - DNA, 16 bp, Artificial Sequence
  synthetic [barcode part1]
gattggccggttagtt

SEQ ID NO: 44454 - DNA, 16 bp, Artificial Sequence
  synthetic [barcode part1]
ttgatcttccgtgaac

SEQ ID NO: 44455 - DNA, 16 bp, Artificial Sequence
  synthetic [barcode part1]
gtcaggttcgcactct

SEQ ID NO: 44456 - DNA, 16 bp, Artificial Sequence
  synthetic [barcode part1]
tagtagttgcgttcct

SEQ ID NO: 44457 - DNA, 16 bp, Artificial Sequence
  synthetic [barcode part1]
tacaccttccaacagt

SEQ ID NO: 44458 - DNA, 16 bp, Artificial Sequence
  synthetic [barcode part1]
cggaccaatcgttaac

SEQ ID NO: 44459 - DNA, 16 bp, Artificial Sequence
  synthetic [barcode part1]
ccgtccgtctaagatc

SEQ ID NO: 44460 - DNA, 16 bp, Artificial Sequence
  synthetic [barcode part1]
tactggaccacgttcc

SEQ ID NO: 44461 - DNA, 16 bp, Artificial Sequence
  synthetic [barcode part1]
gcgtattcggaagacg

SEQ ID NO: 44462 - DNA, 16 bp, Artificial Sequence
  synthetic [barcode part1]
ccactgcggatctgtt

SEQ ID NO: 44463 - DNA, 16 bp, Artificial Sequence
  synthetic [barcode part1]
tctatctgcctgttcg

SEQ ID NO: 44464 - DNA, 16 bp, Artificial Sequence
  synthetic [barcode part1]
tgttccaggacttgtt

SEQ ID NO: 44465 - DNA, 16 bp, Artificial Sequence
  synthetic [barcode part1]
accaggtccgtactct

SEQ ID NO: 44466 - DNA, 16 bp, Artificial Sequence
  synthetic [barcode part1]
atcggttcctctcttg

SEQ ID NO: 44467 - DNA, 16 bp, Artificial Sequence
  synthetic [barcode part1]
tcgtgcctggatcact

SEQ ID NO: 44468 - DNA, 16 bp, Artificial Sequence
  synthetic [barcode part1]
tacggtaagacaggcc

SEQ ID NO: 44469 - DNA, 16 bp, Artificial Sequence
  synthetic [barcode part1]
actagtgagtgcgttc

SEQ ID NO: 44470 - DNA, 16 bp, Artificial Sequence
  synthetic [barcode part1]
tattaacagaggaccg

SEQ ID NO: 44471 - DNA, 16 bp, Artificial Sequence
  synthetic [barcode part1]
gcgtcaacgactcctt

SEQ ID NO: 44472 - DNA, 16 bp, Artificial Sequence
  synthetic [barcode part1]
tgagacttggtaccac

SEQ ID NO: 44473 - DNA, 16 bp, Artificial Sequence
  synthetic [barcode part1]
tcgttaccgtcacctt

SEQ ID NO: 44474 - DNA, 16 bp, Artificial Sequence
  synthetic [barcode part1]
aaccacaacactggtc

SEQ ID NO: 44475 - DNA, 16 bp, Artificial Sequence
  synthetic [barcode part1]
tcgtgattcggttgag

SEQ ID NO: 44476 - DNA, 16 bp, Artificial Sequence
  synthetic [barcode part1]
acctagagtctgcaac

SEQ ID NO: 44477 - DNA, 16 bp, Artificial Sequence
  synthetic [barcode part1]
acactgtgacgaatag

SEQ ID NO: 44478 - DNA, 16 bp, Artificial Sequence
  synthetic [barcode part1]
tggtgccgtgaacaag

SEQ ID NO: 44479 - DNA, 16 bp, Artificial Sequence
  synthetic [barcode part1]
taactcttgcgtagtc

SEQ ID NO: 44480 - DNA, 16 bp, Artificial Sequence
  synthetic [barcode part1]
cggttgattgaggtct

SEQ ID NO: 44481 - DNA, 16 bp, Artificial Sequence
  synthetic [barcode part1]
gtcaggatctcagttg

SEQ ID NO: 44482 - DNA, 16 bp, Artificial Sequence
  synthetic [barcode part1]
cctctcaatagttacg

SEQ ID NO: 44483 - DNA, 16 bp, Artificial Sequence
  synthetic [barcode part1]
tcctacgtgacaattc

SEQ ID NO: 44484 - DNA, 16 bp, Artificial Sequence
  synthetic [barcode part1]
tgtcaagttgtactcc

SEQ ID NO: 44485 - DNA, 16 bp, Artificial Sequence
  synthetic [barcode part1]
tcctgtctcgtgaacg

SEQ ID NO: 44486 - DNA, 16 bp, Artificial Sequence
  synthetic [barcode part1]
tgcactaataccgacg

SEQ ID NO: 44487 - DNA, 16 bp, Artificial Sequence
  synthetic [barcode part1]
cgtcttcttagatcag

SEQ ID NO: 44488 - DNA, 16 bp, Artificial Sequence
  synthetic [barcode part1]
tagacgttgcaccaac

SEQ ID NO: 44489 - DNA, 16 bp, Artificial Sequence
  synthetic [barcode part1]
ccggtccttgttattc

SEQ ID NO: 44490 - DNA, 16 bp, Artificial Sequence
  synthetic [barcode part1]
tgtgtgaagtgtgtcc

SEQ ID NO: 44491 - DNA, 16 bp, Artificial Sequence
  synthetic [barcode part1]
cgttgttgtaggacgt

SEQ ID NO: 44492 - DNA, 16 bp, Artificial Sequence
  synthetic [barcode part1]
cctgtacacgtaagac

SEQ ID NO: 44493 - DNA, 16 bp, Artificial Sequence
  synthetic [barcode part1]
gcgttgagttactctt

SEQ ID NO: 44494 - DNA, 16 bp, Artificial Sequence
  synthetic [barcode part1]
gtgtggttaatcgcgt

SEQ ID NO: 44495 - DNA, 16 bp, Artificial Sequence
  synthetic [barcode part1]
ttatcaagacctggcg

SEQ ID NO: 44496 - DNA, 16 bp, Artificial Sequence
  synthetic [barcode part1]
atcaggttcgcacctc

SEQ ID NO: 44497 - DNA, 16 bp, Artificial Sequence
  synthetic [barcode part1]
gtaattagaggtcgac

SEQ ID NO: 44498 - DNA, 16 bp, Artificial Sequence
  synthetic [barcode part1]
cgtaggtacagacctt

SEQ ID NO: 44499 - DNA, 16 bp, Artificial Sequence
  synthetic [barcode part1]
cactctactgccttgt

SEQ ID NO: 44500 - DNA, 16 bp, Artificial Sequence
  synthetic [barcode part1]
tacgacttggtctccg

SEQ ID NO: 44501 - DNA, 16 bp, Artificial Sequence
  synthetic [barcode part1]
aacgtcaagtctcgac

SEQ ID NO: 44502 - DNA, 16 bp, Artificial Sequence
  synthetic [barcode part1]
tctcaacgtacctagt

SEQ ID NO: 44503 - DNA, 16 bp, Artificial Sequence
  synthetic [barcode part1]
tggcgcagttaggaac

SEQ ID NO: 44504 - DNA, 16 bp, Artificial Sequence
  synthetic [barcode part1]
cactgagttacactct

SEQ ID NO: 44505 - DNA, 16 bp, Artificial Sequence
  synthetic [barcode part1]
aggccaacgatcacag

SEQ ID NO: 44506 - DNA, 16 bp, Artificial Sequence
  synthetic [barcode part1]
aaccggatcgttatcg

SEQ ID NO: 44507 - DNA, 16 bp, Artificial Sequence
  synthetic [barcode part1]
gcgatactctctctct

SEQ ID NO: 44508 - DNA, 16 bp, Artificial Sequence
  synthetic [barcode part1]
ttgtgagattctctgc

SEQ ID NO: 44509 - DNA, 16 bp, Artificial Sequence
  synthetic [barcode part1]
tgtacctgcagagact

SEQ ID NO: 44510 - DNA, 16 bp, Artificial Sequence
  synthetic [barcode part1]
tacttgtaacgttgcc

SEQ ID NO: 44511 - DNA, 16 bp, Artificial Sequence
  synthetic [barcode part1]
ttcgttagattacgcc

SEQ ID NO: 44512 - DNA, 16 bp, Artificial Sequence
  synthetic [barcode part1]
attgtctgaatctgcc

SEQ ID NO: 44513 - DNA, 16 bp, Artificial Sequence
  synthetic [barcode part1]
aatccgattccgcgtc

SEQ ID NO: 44514 - DNA, 16 bp, Artificial Sequence
  synthetic [barcode part1]
ttctctccttctctcc

SEQ ID NO: 44515 - DNA, 16 bp, Artificial Sequence
  synthetic [barcode part1]
gaagattctggaggag

SEQ ID NO: 44516 - DNA, 16 bp, Artificial Sequence
  synthetic [barcode part1]
actaacggacacactc

SEQ ID NO: 44517 - DNA, 16 bp, Artificial Sequence
  synthetic [barcode part1]
acgaaccaccactcct

SEQ ID NO: 44518 - DNA, 16 bp, Artificial Sequence
  synthetic [barcode part1]
attcgcacggtggaag

SEQ ID NO: 44519 - DNA, 16 bp, Artificial Sequence
  synthetic [barcode part1]
cgtgtggtaccttgtc

SEQ ID NO: 44520 - DNA, 16 bp, Artificial Sequence
  synthetic [barcode part1]
gtattctcctctgcac

SEQ ID NO: 44521 - DNA, 16 bp, Artificial Sequence
  synthetic [barcode part1]
tcgtcaactctgcgtg

SEQ ID NO: 44522 - DNA, 16 bp, Artificial Sequence
  synthetic [barcode part1]
cgttattgtggccgtc

SEQ ID NO: 44523 - DNA, 16 bp, Artificial Sequence
  synthetic [barcode part1]
ccgacgttgcaattag

SEQ ID NO: 44524 - DNA, 16 bp, Artificial Sequence
  synthetic [barcode part1]
gcgtaatacgtaccac

SEQ ID NO: 44525 - DNA, 16 bp, Artificial Sequence
  synthetic [barcode part1]
tgagatccacaacgtc

SEQ ID NO: 44526 - DNA, 16 bp, Artificial Sequence
  synthetic [barcode part1]
gcgtgtgttaattggc

SEQ ID NO: 44527 - DNA, 16 bp, Artificial Sequence
  synthetic [barcode part1]
atcgtcttaccgtcct

SEQ ID NO: 44528 - DNA, 16 bp, Artificial Sequence
  synthetic [barcode part1]
tcggagagttatcctg

SEQ ID NO: 44529 - DNA, 16 bp, Artificial Sequence
  synthetic [barcode part1]
gtcacggtacctgttc

SEQ ID NO: 44530 - DNA, 16 bp, Artificial Sequence
  synthetic [barcode part1]
gatcacggacctcctt

SEQ ID NO: 44531 - DNA, 16 bp, Artificial Sequence
  synthetic [barcode part1]
ttctcaatagtgtgcc

SEQ ID NO: 44532 - DNA, 16 bp, Artificial Sequence
  synthetic [barcode part1]
atcttactatcgacgc

SEQ ID NO: 44533 - DNA, 16 bp, Artificial Sequence
  synthetic [barcode part1]
caagacctcctgaagt

SEQ ID NO: 44534 - DNA, 16 bp, Artificial Sequence
  synthetic [barcode part1]
gagttggaccagtgtg

SEQ ID NO: 44535 - DNA, 16 bp, Artificial Sequence
  synthetic [barcode part1]
aacacctacaatcgcg

SEQ ID NO: 44536 - DNA, 16 bp, Artificial Sequence
  synthetic [barcode part1]
accaggagtatatcag

SEQ ID NO: 44537 - DNA, 16 bp, Artificial Sequence
  synthetic [barcode part1]
atcagatctgtgcctt

SEQ ID NO: 44538 - DNA, 16 bp, Artificial Sequence
  synthetic [barcode part1]
cggagtatcacgcaag

SEQ ID NO: 44539 - DNA, 16 bp, Artificial Sequence
  synthetic [barcode part1]
ttcagtgtggatcacg

SEQ ID NO: 44540 - DNA, 16 bp, Artificial Sequence
  synthetic [barcode part1]
acctcgtacaattgtc

SEQ ID NO: 44541 - DNA, 16 bp, Artificial Sequence
  synthetic [barcode part1]
caggtataatcacgcc

SEQ ID NO: 44542 - DNA, 16 bp, Artificial Sequence
  synthetic [barcode part1]
gcgacctcttgataag

SEQ ID NO: 44543 - DNA, 16 bp, Artificial Sequence
  synthetic [barcode part1]
agtacgtagaactgac

SEQ ID NO: 44544 - DNA, 16 bp, Artificial Sequence
  synthetic [barcode part1]
ttgatctctgcgtggc

SEQ ID NO: 44545 - DNA, 16 bp, Artificial Sequence
  synthetic [barcode part1]
accgtcctatccaggt

SEQ ID NO: 44546 - DNA, 16 bp, Artificial Sequence
  synthetic [barcode part1]
gtgtggattcagtaag

SEQ ID NO: 44547 - DNA, 16 bp, Artificial Sequence
  synthetic [barcode part1]
tgactcctggttatac

SEQ ID NO: 44548 - DNA, 16 bp, Artificial Sequence
  synthetic [barcode part1]
aataaggaactcgtgc

SEQ ID NO: 44549 - DNA, 16 bp, Artificial Sequence
  synthetic [barcode part1]
acgactaatacgccac

SEQ ID NO: 44550 - DNA, 16 bp, Artificial Sequence
  synthetic [barcode part1]
cctggtcaacttctct

SEQ ID NO: 44551 - DNA, 16 bp, Artificial Sequence
  synthetic [barcode part1]
tctgaccgaagaactc

SEQ ID NO: 44552 - DNA, 16 bp, Artificial Sequence
  synthetic [barcode part1]
ttcgtgacaccacctg

SEQ ID NO: 44553 - DNA, 16 bp, Artificial Sequence
  synthetic [barcode part1]
gtgatcttcgcgttcg

SEQ ID NO: 44554 - DNA, 16 bp, Artificial Sequence
  synthetic [barcode part1]
ttggactaagacacag

SEQ ID NO: 44555 - DNA, 16 bp, Artificial Sequence
  synthetic [barcode part1]
acgtgtgacgttacgt

SEQ ID NO: 44556 - DNA, 16 bp, Artificial Sequence
  synthetic [barcode part1]
atcggtagagttgaac

SEQ ID NO: 44557 - DNA, 16 bp, Artificial Sequence
  synthetic [barcode part1]
gcgcggttctcaatct

SEQ ID NO: 44558 - DNA, 16 bp, Artificial Sequence
  synthetic [barcode part1]
gtgtccgatcttgtcg

SEQ ID NO: 44559 - DNA, 16 bp, Artificial Sequence
  synthetic [barcode part1]
agactcaggtgtatcc

SEQ ID NO: 44560 - DNA, 16 bp, Artificial Sequence
  synthetic [barcode part1]
ccgaacgttacaagtc

SEQ ID NO: 44561 - DNA, 16 bp, Artificial Sequence
  synthetic [barcode part1]
cgtgaagaccgttgag

SEQ ID NO: 44562 - DNA, 16 bp, Artificial Sequence
  synthetic [barcode part1]
gtatcgtagtagacag

SEQ ID NO: 44563 - DNA, 16 bp, Artificial Sequence
  synthetic [barcode part1]
caattgaggtcgacct

SEQ ID NO: 44564 - DNA, 16 bp, Artificial Sequence
  synthetic [barcode part1]
ccaacttgcaactgtt

SEQ ID NO: 44565 - DNA, 16 bp, Artificial Sequence
  synthetic [barcode part1]
aaccgtgagttaaggt

SEQ ID NO: 44566 - DNA, 16 bp, Artificial Sequence
  synthetic [barcode part1]
acactacgcagtatcg

SEQ ID NO: 44567 - DNA, 16 bp, Artificial Sequence
  synthetic [barcode part1]
cgaactgagtcgttgt

SEQ ID NO: 44568 - DNA, 16 bp, Artificial Sequence
  synthetic [barcode part1]
cgtaccttaccgagtc

SEQ ID NO: 44569 - DNA, 16 bp, Artificial Sequence
  synthetic [barcode part1]
agtctgtcctaggtag

SEQ ID NO: 44570 - DNA, 16 bp, Artificial Sequence
  synthetic [barcode part1]
cgcgagtgtgatagac

SEQ ID NO: 44571 - DNA, 16 bp, Artificial Sequence
  synthetic [barcode part1]
attagtacgccttacc

SEQ ID NO: 44572 - DNA, 16 bp, Artificial Sequence
  synthetic [barcode part1]
gtcggacgataatctc

SEQ ID NO: 44573 - DNA, 16 bp, Artificial Sequence
  synthetic [barcode part1]
tctcgaacctgcctag

SEQ ID NO: 44574 - DNA, 16 bp, Artificial Sequence
  synthetic [barcode part1]
tcgaggtcttaggact

SEQ ID NO: 44575 - DNA, 16 bp, Artificial Sequence
  synthetic [barcode part1]
atagtactcgaggcct

SEQ ID NO: 44576 - DNA, 16 bp, Artificial Sequence
  synthetic [barcode part1]
gattcaacgactcggt

SEQ ID NO: 44577 - DNA, 16 bp, Artificial Sequence
  synthetic [barcode part1]
tcaaggtaggtctcac

SEQ ID NO: 44578 - DNA, 16 bp, Artificial Sequence
  synthetic [barcode part1]
atctcagaccacagtg

SEQ ID NO: 44579 - DNA, 16 bp, Artificial Sequence
  synthetic [barcode part1]
cgccgtcacgattatc

SEQ ID NO: 44580 - DNA, 16 bp, Artificial Sequence
  synthetic [barcode part1]
cctatagtcgtgagtg

SEQ ID NO: 44581 - DNA, 16 bp, Artificial Sequence
  synthetic [barcode part1]
agtgacctgcgttcct

SEQ ID NO: 44582 - DNA, 16 bp, Artificial Sequence
  synthetic [barcode part1]
tcagtaggtccgatac

SEQ ID NO: 44583 - DNA, 16 bp, Artificial Sequence
  synthetic [barcode part1]
tacaggtgtagactcc

SEQ ID NO: 44584 - DNA, 16 bp, Artificial Sequence
  synthetic [barcode part1]
tagtggttgtggaggc

SEQ ID NO: 44585 - DNA, 16 bp, Artificial Sequence
  synthetic [barcode part1]
gtggccgtcttaacct

SEQ ID NO: 44586 - DNA, 16 bp, Artificial Sequence
  synthetic [barcode part1]
tagtacgaagaaccac

SEQ ID NO: 44587 - DNA, 16 bp, Artificial Sequence
  synthetic [barcode part1]
tggttaggttaaccgc

SEQ ID NO: 44588 - DNA, 16 bp, Artificial Sequence
  synthetic [barcode part1]
cagtgtgtgcagactt

SEQ ID NO: 44589 - DNA, 16 bp, Artificial Sequence
  synthetic [barcode part1]
acgactggaggttggt

SEQ ID NO: 44590 - DNA, 16 bp, Artificial Sequence
  synthetic [barcode part1]
acgccaagtcacctct

SEQ ID NO: 44591 - DNA, 16 bp, Artificial Sequence
  synthetic [barcode part1]
agtcactctgtgtccg

SEQ ID NO: 44592 - DNA, 16 bp, Artificial Sequence
  synthetic [barcode part1]
acgttcttggtgactt

SEQ ID NO: 44593 - DNA, 16 bp, Artificial Sequence
  synthetic [barcode part1]
gtctcgttcgtacgac

SEQ ID NO: 44594 - DNA, 16 bp, Artificial Sequence
  synthetic [barcode part1]
ttagacgttcgtcgcc

SEQ ID NO: 44595 - DNA, 16 bp, Artificial Sequence
  synthetic [barcode part1]
caagtcgccttgtatt

SEQ ID NO: 44596 - DNA, 16 bp, Artificial Sequence
  synthetic [barcode part1]
gcagactaaccacact

SEQ ID NO: 44597 - DNA, 16 bp, Artificial Sequence
  synthetic [barcode part1]
atagacctgataaggc

SEQ ID NO: 44598 - DNA, 16 bp, Artificial Sequence
  synthetic [barcode part1]
aacaattctaggccgc

SEQ ID NO: 44599 - DNA, 16 bp, Artificial Sequence
  synthetic [barcode part1]
gtccacgatcacttcg

SEQ ID NO: 44600 - DNA, 16 bp, Artificial Sequence
  synthetic [barcode part1]
tgacttggtaagaacg

SEQ ID NO: 44601 - DNA, 16 bp, Artificial Sequence
  synthetic [barcode part1]
cagagacttgtgttcg

SEQ ID NO: 44602 - DNA, 16 bp, Artificial Sequence
  synthetic [barcode part1]
tccttaagtactggtc

SEQ ID NO: 44603 - DNA, 16 bp, Artificial Sequence
  synthetic [barcode part1]
attggtctcggttgag

SEQ ID NO: 44604 - DNA, 16 bp, Artificial Sequence
  synthetic [barcode part1]
ccggttctctgatctt

SEQ ID NO: 44605 - DNA, 16 bp, Artificial Sequence
  synthetic [barcode part1]
ttgcagaaggtactcc

SEQ ID NO: 44606 - DNA, 16 bp, Artificial Sequence
  synthetic [barcode part1]
ttcactgcgtagactt

SEQ ID NO: 44607 - DNA, 16 bp, Artificial Sequence
  synthetic [barcode part1]
ccttggttcgaacacc

SEQ ID NO: 44608 - DNA, 16 bp, Artificial Sequence
  synthetic [barcode part1]
acgataccggtactac

SEQ ID NO: 44609 - DNA, 16 bp, Artificial Sequence
  synthetic [barcode part1]
cgcgacgtcacttgtt

SEQ ID NO: 44610 - DNA, 16 bp, Artificial Sequence
  synthetic [barcode part1]
acggttactggaggac

SEQ ID NO: 44611 - DNA, 16 bp, Artificial Sequence
  synthetic [barcode part1]
attctatctgcacggt

SEQ ID NO: 44612 - DNA, 16 bp, Artificial Sequence
  synthetic [barcode part1]
ttggtactcgattctg

SEQ ID NO: 44613 - DNA, 16 bp, Artificial Sequence
  synthetic [barcode part1]
actcttgacctggcgt

SEQ ID NO: 44614 - DNA, 16 bp, Artificial Sequence
  synthetic [barcode part1]
gacgtgtacactggtt

SEQ ID NO: 44615 - DNA, 16 bp, Artificial Sequence
  synthetic [barcode part1]
cgtgcggtctagttct

SEQ ID NO: 44616 - DNA, 16 bp, Artificial Sequence
  synthetic [barcode part1]
aggacaatcgtggatt

SEQ ID NO: 44617 - DNA, 16 bp, Artificial Sequence
  synthetic [barcode part1]
gtctcactgaactcgc

SEQ ID NO: 44618 - DNA, 16 bp, Artificial Sequence
  synthetic [barcode part1]
aacttgcaggcgacag

SEQ ID NO: 44619 - DNA, 16 bp, Artificial Sequence
  synthetic [barcode part1]
cgtgttagaagttgag

SEQ ID NO: 44620 - DNA, 16 bp, Artificial Sequence
  synthetic [barcode part1]
cacctaacgcaagttg

SEQ ID NO: 44621 - DNA, 16 bp, Artificial Sequence
  synthetic [barcode part1]
tcggacgtattcgaac

SEQ ID NO: 44622 - DNA, 16 bp, Artificial Sequence
  synthetic [barcode part1]
acaggtcttcctaact

SEQ ID NO: 44623 - DNA, 16 bp, Artificial Sequence
  synthetic [barcode part1]
tacgtgaagacactcc

SEQ ID NO: 44624 - DNA, 16 bp, Artificial Sequence
  synthetic [barcode part1]
tctgcgtcaataactc

SEQ ID NO: 44625 - DNA, 16 bp, Artificial Sequence
  synthetic [barcode part1]
tcacacacacacaacg

SEQ ID NO: 44626 - DNA, 16 bp, Artificial Sequence
  synthetic [barcode part1]
gacgaaggaagtgatc

SEQ ID NO: 44627 - DNA, 16 bp, Artificial Sequence
  synthetic [barcode part1]
agtgtcgaactctggt

SEQ ID NO: 44628 - DNA, 16 bp, Artificial Sequence
  synthetic [barcode part1]
tcctgcgagagatact

SEQ ID NO: 44629 - DNA, 16 bp, Artificial Sequence
  synthetic [barcode part1]
cgtgttacacgatcag

SEQ ID NO: 44630 - DNA, 16 bp, Artificial Sequence
  synthetic [barcode part1]
taggttacacgtctct

SEQ ID NO: 44631 - DNA, 16 bp, Artificial Sequence
  synthetic [barcode part1]
cacagagttgagttag

SEQ ID NO: 44632 - DNA, 16 bp, Artificial Sequence
  synthetic [barcode part1]
aagaatccaatacgcg

SEQ ID NO: 44633 - DNA, 16 bp, Artificial Sequence
  synthetic [barcode part1]
gactgagacttcctag

SEQ ID NO: 44634 - DNA, 16 bp, Artificial Sequence
  synthetic [barcode part1]
aacaagaccggacgtc

SEQ ID NO: 44635 - DNA, 16 bp, Artificial Sequence
  synthetic [barcode part1]
tcgatccacaaggtac

SEQ ID NO: 44636 - DNA, 16 bp, Artificial Sequence
  synthetic [barcode part1]
ttccttctcaatcggc

SEQ ID NO: 44637 - DNA, 16 bp, Artificial Sequence
  synthetic [barcode part1]
acaactacttcggtct

SEQ ID NO: 44638 - DNA, 16 bp, Artificial Sequence
  synthetic [barcode part1]
gcggagaagttcgact

SEQ ID NO: 44639 - DNA, 16 bp, Artificial Sequence
  synthetic [barcode part1]
cctaccagtgttcgac

SEQ ID NO: 44640 - DNA, 16 bp, Artificial Sequence
  synthetic [barcode part1]
gagtgttcttaggtgc

SEQ ID NO: 44641 - DNA, 16 bp, Artificial Sequence
  synthetic [barcode part1]
gagttggtcttagtcg

SEQ ID NO: 44642 - DNA, 16 bp, Artificial Sequence
  synthetic [barcode part1]
gttcagataggacaac

SEQ ID NO: 44643 - DNA, 16 bp, Artificial Sequence
  synthetic [barcode part1]
acagtgtgtgtcacac

SEQ ID NO: 44644 - DNA, 16 bp, Artificial Sequence
  synthetic [barcode part1]
gcagttgtgtgcaact

SEQ ID NO: 44645 - DNA, 16 bp, Artificial Sequence
  synthetic [barcode part1]
cactccagtggacttc

SEQ ID NO: 44646 - DNA, 16 bp, Artificial Sequence
  synthetic [barcode part1]
tcttacggccgaacct

SEQ ID NO: 44647 - DNA, 16 bp, Artificial Sequence
  synthetic [barcode part1]
gtggaaggattcaatc

SEQ ID NO: 44648 - DNA, 16 bp, Artificial Sequence
  synthetic [barcode part1]
atccgtaacacgactg

SEQ ID NO: 44649 - DNA, 16 bp, Artificial Sequence
  synthetic [barcode part1]
tggcaacttctcgcgt

SEQ ID NO: 44650 - DNA, 16 bp, Artificial Sequence
  synthetic [barcode part1]
cacggatataacaggt

SEQ ID NO: 44651 - DNA, 16 bp, Artificial Sequence
  synthetic [barcode part1]
gatcgactaacaccgt

SEQ ID NO: 44652 - DNA, 16 bp, Artificial Sequence
  synthetic [barcode part1]
ttggcaggttcttact

SEQ ID NO: 44653 - DNA, 16 bp, Artificial Sequence
  synthetic [barcode part1]
atcgtagacagacggc

SEQ ID NO: 44654 - DNA, 16 bp, Artificial Sequence
  synthetic [barcode part1]
attcgcaccttgttag

SEQ ID NO: 44655 - DNA, 16 bp, Artificial Sequence
  synthetic [barcode part1]
ccactctaggatagtg

SEQ ID NO: 44656 - DNA, 16 bp, Artificial Sequence
  synthetic [barcode part1]
accgatactgtacgac

SEQ ID NO: 44657 - DNA, 16 bp, Artificial Sequence
  synthetic [barcode part1]
tgtgactaaccacacg

SEQ ID NO: 44658 - DNA, 16 bp, Artificial Sequence
  synthetic [barcode part1]
ttatcgtcggagtgac

SEQ ID NO: 44659 - DNA, 16 bp, Artificial Sequence
  synthetic [barcode part1]
tctctgaactggtact

SEQ ID NO: 44660 - DNA, 16 bp, Artificial Sequence
  synthetic [barcode part1]
attatactctccgacg

SEQ ID NO: 44661 - DNA, 16 bp, Artificial Sequence
  synthetic [barcode part1]
cgagtcctactgttcg

SEQ ID NO: 44662 - DNA, 16 bp, Artificial Sequence
  synthetic [barcode part1]
gcgtattgtaaggtag

SEQ ID NO: 44663 - DNA, 16 bp, Artificial Sequence
  synthetic [barcode part1]
gaagattgaccggaag

SEQ ID NO: 44664 - DNA, 16 bp, Artificial Sequence
  synthetic [barcode part1]
gcctggatatctgaac

SEQ ID NO: 44665 - DNA, 16 bp, Artificial Sequence
  synthetic [barcode part1]
tcgtggaagtgatagt

SEQ ID NO: 44666 - DNA, 16 bp, Artificial Sequence
  synthetic [barcode part1]
tgcagtgtgcctacct

SEQ ID NO: 44667 - DNA, 16 bp, Artificial Sequence
  synthetic [barcode part1]
agtcgcctattcttag

SEQ ID NO: 44668 - DNA, 16 bp, Artificial Sequence
  synthetic [barcode part1]
actgagttgccaagtc

SEQ ID NO: 44669 - DNA, 16 bp, Artificial Sequence
  synthetic [barcode part1]
taactcttccttcggc

SEQ ID NO: 44670 - DNA, 16 bp, Artificial Sequence
  synthetic [barcode part1]
cgtacaatagacctgc

SEQ ID NO: 44671 - DNA, 16 bp, Artificial Sequence
  synthetic [barcode part1]
tattgcggtcgactag

SEQ ID NO: 44672 - DNA, 16 bp, Artificial Sequence
  synthetic [barcode part1]
gtcgtattggcgagag

SEQ ID NO: 44673 - DNA, 16 bp, Artificial Sequence
  synthetic [barcode part1]
aggttactgttcttgc

SEQ ID NO: 44674 - DNA, 16 bp, Artificial Sequence
  synthetic [barcode part1]
taacttccgactgtac

SEQ ID NO: 44675 - DNA, 16 bp, Artificial Sequence
  synthetic [barcode part1]
tacgagtggtagaatc

SEQ ID NO: 44676 - DNA, 16 bp, Artificial Sequence
  synthetic [barcode part1]
ttcctcctggttgact

SEQ ID NO: 44677 - DNA, 16 bp, Artificial Sequence
  synthetic [barcode part1]
cgacgtcacttacctg

SEQ ID NO: 44678 - DNA, 16 bp, Artificial Sequence
  synthetic [barcode part1]
tgagaaggttacgtgt

SEQ ID NO: 44679 - DNA, 16 bp, Artificial Sequence
  synthetic [barcode part1]
tagaccacctctgtgc

SEQ ID NO: 44680 - DNA, 16 bp, Artificial Sequence
  synthetic [barcode part1]
atagtcaacacgccgt

SEQ ID NO: 44681 - DNA, 16 bp, Artificial Sequence
  synthetic [barcode part1]
tccgcgatcactctag

SEQ ID NO: 44682 - DNA, 16 bp, Artificial Sequence
  synthetic [barcode part1]
taagagtgtcctcacg

SEQ ID NO: 44683 - DNA, 16 bp, Artificial Sequence
  synthetic [barcode part1]
gcagttaggaactggc

SEQ ID NO: 44684 - DNA, 16 bp, Artificial Sequence
  synthetic [barcode part1]
gaggcctacagacaac

SEQ ID NO: 44685 - DNA, 16 bp, Artificial Sequence
  synthetic [barcode part1]
gactactgtgaggacg

SEQ ID NO: 44686 - DNA, 16 bp, Artificial Sequence
  synthetic [barcode part1]
actgttcgacgcctgt

SEQ ID NO: 44687 - DNA, 16 bp, Artificial Sequence
  synthetic [barcode part1]
aggttgttgcctccac

SEQ ID NO: 44688 - DNA, 16 bp, Artificial Sequence
  synthetic [barcode part1]
tgcctggagaggttag

SEQ ID NO: 44689 - DNA, 16 bp, Artificial Sequence
  synthetic [barcode part1]
aattcaagaagacgcc

SEQ ID NO: 44690 - DNA, 16 bp, Artificial Sequence
  synthetic [barcode part1]
gtgagtccaacggagt

SEQ ID NO: 44691 - DNA, 16 bp, Artificial Sequence
  synthetic [barcode part1]
taatcgcgtgattgcg

SEQ ID NO: 44692 - DNA, 16 bp, Artificial Sequence
  synthetic [barcode part1]
tagtattggcaggtag

SEQ ID NO: 44693 - DNA, 16 bp, Artificial Sequence
  synthetic [barcode part1]
cgtatctgtcctcact

SEQ ID NO: 44694 - DNA, 16 bp, Artificial Sequence
  synthetic [barcode part1]
accttgtcagattcgt

SEQ ID NO: 44695 - DNA, 16 bp, Artificial Sequence
  synthetic [barcode part1]
ttcctatcgaatcgtg

SEQ ID NO: 44696 - DNA, 16 bp, Artificial Sequence
  synthetic [barcode part1]
ccacagaagacgttct

SEQ ID NO: 44697 - DNA, 16 bp, Artificial Sequence
  synthetic [barcode part1]
atcgatagacggtagt

SEQ ID NO: 44698 - DNA, 16 bp, Artificial Sequence
  synthetic [barcode part1]
gtcagattgtcaggtc

SEQ ID NO: 44699 - DNA, 16 bp, Artificial Sequence
  synthetic [barcode part1]
cgagactacgttgtgt

SEQ ID NO: 44700 - DNA, 16 bp, Artificial Sequence
  synthetic [barcode part1]
aggcctgaatacactc

SEQ ID NO: 44701 - DNA, 16 bp, Artificial Sequence
  synthetic [barcode part1]
ccttagactacttacg

SEQ ID NO: 44702 - DNA, 16 bp, Artificial Sequence
  synthetic [barcode part1]
accgcgtctcttaacg

SEQ ID NO: 44703 - DNA, 16 bp, Artificial Sequence
  synthetic [barcode part1]
cgagaagattggtgcc

SEQ ID NO: 44704 - DNA, 16 bp, Artificial Sequence
  synthetic [barcode part1]
gtgttaagtgtggcct

SEQ ID NO: 44705 - DNA, 16 bp, Artificial Sequence
  synthetic [barcode part1]
tgtgacactgcagtac

SEQ ID NO: 44706 - DNA, 16 bp, Artificial Sequence
  synthetic [barcode part1]
tacaccaggagagtcg

SEQ ID NO: 44707 - DNA, 16 bp, Artificial Sequence
  synthetic [barcode part1]
cgtatagagtaacgac

SEQ ID NO: 44708 - DNA, 16 bp, Artificial Sequence
  synthetic [barcode part1]
ttgtcgttcgtagact

SEQ ID NO: 44709 - DNA, 16 bp, Artificial Sequence
  synthetic [barcode part1]
atcggcgtgaggaatc

SEQ ID NO: 44710 - DNA, 16 bp, Artificial Sequence
  synthetic [barcode part1]
aggcctatagactcgt

SEQ ID NO: 44711 - DNA, 16 bp, Artificial Sequence
  synthetic [barcode part1]
cactaagtctggcaac

SEQ ID NO: 44712 - DNA, 16 bp, Artificial Sequence
  synthetic [barcode part1]
tattctccggtggtcg

SEQ ID NO: 44713 - DNA, 16 bp, Artificial Sequence
  synthetic [barcode part1]
atacggtccgaaggac

SEQ ID NO: 44714 - DNA, 16 bp, Artificial Sequence
  synthetic [barcode part1]
gcgtcacgaatagacg

SEQ ID NO: 44715 - DNA, 16 bp, Artificial Sequence
  synthetic [barcode part1]
gcctatatcttcaacg

SEQ ID NO: 44716 - DNA, 16 bp, Artificial Sequence
  synthetic [barcode part1]
cctgaccgtgccaatt

SEQ ID NO: 44717 - DNA, 16 bp, Artificial Sequence
  synthetic [barcode part1]
ccttgtcagtagagtg

SEQ ID NO: 44718 - DNA, 16 bp, Artificial Sequence
  synthetic [barcode part1]
tctcaactcgagtact

SEQ ID NO: 44719 - DNA, 16 bp, Artificial Sequence
  synthetic [barcode part1]
cgtgtgagaacgttct

SEQ ID NO: 44720 - DNA, 16 bp, Artificial Sequence
  synthetic [barcode part1]
cgtgtcgattgtgtag

SEQ ID NO: 44721 - DNA, 16 bp, Artificial Sequence
  synthetic [barcode part1]
agtgttgagtctcgac

SEQ ID NO: 44722 - DNA, 16 bp, Artificial Sequence
  synthetic [barcode part1]
gtcggatccacactct

SEQ ID NO: 44723 - DNA, 16 bp, Artificial Sequence
  synthetic [barcode part1]
ttcgtgcaacttaacc

SEQ ID NO: 44724 - DNA, 16 bp, Artificial Sequence
  synthetic [barcode part1]
gcgaagacaacctgac

SEQ ID NO: 44725 - DNA, 16 bp, Artificial Sequence
  synthetic [barcode part1]
gattctgtattcaccg

SEQ ID NO: 44726 - DNA, 16 bp, Artificial Sequence
  synthetic [barcode part1]
agacactgtggacttc

SEQ ID NO: 44727 - DNA, 16 bp, Artificial Sequence
  synthetic [barcode part1]
gtcttagtcctccttg

SEQ ID NO: 44728 - DNA, 16 bp, Artificial Sequence
  synthetic [barcode part1]
acttcgactgaccaag

SEQ ID NO: 44729 - DNA, 16 bp, Artificial Sequence
  synthetic [barcode part1]
gtcaatctccttcctg

SEQ ID NO: 44730 - DNA, 16 bp, Artificial Sequence
  synthetic [barcode part1]
tgagtatcgtgccagt

SEQ ID NO: 44731 - DNA, 16 bp, Artificial Sequence
  synthetic [barcode part1]
ttgaacgtctaggtgc

SEQ ID NO: 44732 - DNA, 16 bp, Artificial Sequence
  synthetic [barcode part1]
gtgttgactggatacc

SEQ ID NO: 44733 - DNA, 16 bp, Artificial Sequence
  synthetic [barcode part1]
tactcgcgaacagatc

SEQ ID NO: 44734 - DNA, 16 bp, Artificial Sequence
  synthetic [barcode part1]
taggtaacactacgag

SEQ ID NO: 44735 - DNA, 16 bp, Artificial Sequence
  synthetic [barcode part1]
ccgacttcaagaagtc

SEQ ID NO: 44736 - DNA, 16 bp, Artificial Sequence
  synthetic [barcode part1]
accaggttgccgaatt

SEQ ID NO: 44737 - DNA, 16 bp, Artificial Sequence
  synthetic [barcode part1]
agaatacgcacctctg

SEQ ID NO: 44738 - DNA, 16 bp, Artificial Sequence
  synthetic [barcode part1]
caagacgcggacttag

SEQ ID NO: 44739 - DNA, 16 bp, Artificial Sequence
  synthetic [barcode part1]
accagttggaatcctg

SEQ ID NO: 44740 - DNA, 16 bp, Artificial Sequence
  synthetic [barcode part1]
ccaagagtgtagaccg

SEQ ID NO: 44741 - DNA, 16 bp, Artificial Sequence
  synthetic [barcode part1]
cctgcgaatagatctg

SEQ ID NO: 44742 - DNA, 16 bp, Artificial Sequence
  synthetic [barcode part1]
aggacttctcgcctac

SEQ ID NO: 44743 - DNA, 16 bp, Artificial Sequence
  synthetic [barcode part1]
ttaaccggattggtcg

SEQ ID NO: 44744 - DNA, 16 bp, Artificial Sequence
  synthetic [barcode part1]
tgttaccgacgtgcct

SEQ ID NO: 44745 - DNA, 16 bp, Artificial Sequence
  synthetic [barcode part1]
tctattcggtatcgtg

SEQ ID NO: 44746 - DNA, 16 bp, Artificial Sequence
  synthetic [barcode part1]
gactcggcaataactc

SEQ ID NO: 44747 - DNA, 16 bp, Artificial Sequence
  synthetic [barcode part1]
tgaacacgatctgcac

SEQ ID NO: 44748 - DNA, 16 bp, Artificial Sequence
  synthetic [barcode part1]
cctaggagtgcgtatt

SEQ ID NO: 44749 - DNA, 16 bp, Artificial Sequence
  synthetic [barcode part1]
aatatactctctcggc

SEQ ID NO: 44750 - DNA, 16 bp, Artificial Sequence
  synthetic [barcode part1]
tccttatcgccgagtg

SEQ ID NO: 44751 - DNA, 16 bp, Artificial Sequence
  synthetic [barcode part1]
gtctgttaggttctgt

SEQ ID NO: 44752 - DNA, 16 bp, Artificial Sequence
  synthetic [barcode part1]
ttctatcgcctcactg

SEQ ID NO: 44753 - DNA, 16 bp, Artificial Sequence
  synthetic [barcode part1]
atagaacgtgaatccg

SEQ ID NO: 44754 - DNA, 16 bp, Artificial Sequence
  synthetic [barcode part1]
gcaattggattggaac

SEQ ID NO: 44755 - DNA, 16 bp, Artificial Sequence
  synthetic [barcode part1]
cctatcgttaacacac

SEQ ID NO: 44756 - DNA, 16 bp, Artificial Sequence
  synthetic [barcode part1]
actacgtctgagtgtg

SEQ ID NO: 44757 - DNA, 16 bp, Artificial Sequence
  synthetic [barcode part1]
gcgatatcagttgacc

SEQ ID NO: 44758 - DNA, 16 bp, Artificial Sequence
  synthetic [barcode part1]
tgattgcgacgataag

SEQ ID NO: 44759 - DNA, 16 bp, Artificial Sequence
  synthetic [barcode part1]
agtattggaccggtct

SEQ ID NO: 44760 - DNA, 16 bp, Artificial Sequence
  synthetic [barcode part1]
tccgcagagtaagacg

SEQ ID NO: 44761 - DNA, 16 bp, Artificial Sequence
  synthetic [barcode part1]
tggtgaccaactcagt

SEQ ID NO: 44762 - DNA, 16 bp, Artificial Sequence
  synthetic [barcode part1]
agttcgacctcgtgtc

SEQ ID NO: 44763 - DNA, 16 bp, Artificial Sequence
  synthetic [barcode part1]
aggaattcagtgtacg

SEQ ID NO: 44764 - DNA, 16 bp, Artificial Sequence
  synthetic [barcode part1]
aggtaagtgtccacct

SEQ ID NO: 44765 - DNA, 16 bp, Artificial Sequence
  synthetic [barcode part1]
aagaccggcgtgattg

SEQ ID NO: 44766 - DNA, 16 bp, Artificial Sequence
  synthetic [barcode part1]
caggaagtgcgtagtc

SEQ ID NO: 44767 - DNA, 16 bp, Artificial Sequence
  synthetic [barcode part1]
ttccacagactcgatt

SEQ ID NO: 44768 - DNA, 16 bp, Artificial Sequence
  synthetic [barcode part1]
gagttcggatacgtct

SEQ ID NO: 44769 - DNA, 16 bp, Artificial Sequence
  synthetic [barcode part1]
tcggattatcagaccg

SEQ ID NO: 44770 - DNA, 16 bp, Artificial Sequence
  synthetic [barcode part1]
tatccgcgcagtatcc

SEQ ID NO: 44771 - DNA, 16 bp, Artificial Sequence
  synthetic [barcode part1]
ttgccacgaacctacc

SEQ ID NO: 44772 - DNA, 16 bp, Artificial Sequence
  synthetic [barcode part1]
aatattcctatcgccg

SEQ ID NO: 44773 - DNA, 16 bp, Artificial Sequence
  synthetic [barcode part1]
gcagttgaagattggt

SEQ ID NO: 44774 - DNA, 16 bp, Artificial Sequence
  synthetic [barcode part1]
tccacactgacagtcc

SEQ ID NO: 44775 - DNA, 16 bp, Artificial Sequence
  synthetic [barcode part1]
aacggtgagattcgcg

SEQ ID NO: 44776 - DNA, 16 bp, Artificial Sequence
  synthetic [barcode part1]
taagaggtacgtggtt

SEQ ID NO: 44777 - DNA, 16 bp, Artificial Sequence
  synthetic [barcode part1]
gttctgtgtctcctgt

SEQ ID NO: 44778 - DNA, 16 bp, Artificial Sequence
  synthetic [barcode part1]
aagaagtcaggaggtc

SEQ ID NO: 44779 - DNA, 16 bp, Artificial Sequence
  synthetic [barcode part1]
agaaccggttaggaag

SEQ ID NO: 44780 - DNA, 16 bp, Artificial Sequence
  synthetic [barcode part1]
ccagatacttgaacgc

SEQ ID NO: 44781 - DNA, 16 bp, Artificial Sequence
  synthetic [barcode part1]
acaatccgtggagacg

SEQ ID NO: 44782 - DNA, 16 bp, Artificial Sequence
  synthetic [barcode part1]
cgttgtaaggagagag

SEQ ID NO: 44783 - DNA, 16 bp, Artificial Sequence
  synthetic [barcode part1]
gcaagttgcgtaatcc

SEQ ID NO: 44784 - DNA, 16 bp, Artificial Sequence
  synthetic [barcode part1]
ccaggatctattcgtt

SEQ ID NO: 44785 - DNA, 16 bp, Artificial Sequence
  synthetic [barcode part1]
tcctgtctcacagacg

SEQ ID NO: 44786 - DNA, 16 bp, Artificial Sequence
  synthetic [barcode part1]
cacacaactgtgtgac

SEQ ID NO: 44787 - DNA, 16 bp, Artificial Sequence
  synthetic [barcode part1]
acctagactaccttac

SEQ ID NO: 44788 - DNA, 16 bp, Artificial Sequence
  synthetic [barcode part1]
cggtccttcaacttct

SEQ ID NO: 44789 - DNA, 16 bp, Artificial Sequence
  synthetic [barcode part1]
gtgttcttgcactcct

SEQ ID NO: 44790 - DNA, 16 bp, Artificial Sequence
  synthetic [barcode part1]
ttaacgactcgacggt

SEQ ID NO: 44791 - DNA, 16 bp, Artificial Sequence
  synthetic [barcode part1]
tcctctcagagtctct

SEQ ID NO: 44792 - DNA, 16 bp, Artificial Sequence
  synthetic [barcode part1]
tgcgtccggtagtctt

SEQ ID NO: 44793 - DNA, 16 bp, Artificial Sequence
  synthetic [barcode part1]
acacctctcttgtgtc

SEQ ID NO: 44794 - DNA, 16 bp, Artificial Sequence
  synthetic [barcode part1]
tacaaccggttcgtag

SEQ ID NO: 44795 - DNA, 16 bp, Artificial Sequence
  synthetic [barcode part1]
tgcagtgacagatagt

SEQ ID NO: 44796 - DNA, 16 bp, Artificial Sequence
  synthetic [barcode part1]
agaataggcagacttc

SEQ ID NO: 44797 - DNA, 16 bp, Artificial Sequence
  synthetic [barcode part1]
cacaggcaagtaatac

SEQ ID NO: 44798 - DNA, 16 bp, Artificial Sequence
  synthetic [barcode part1]
tcagtagtgttaggcc

SEQ ID NO: 44799 - DNA, 16 bp, Artificial Sequence
  synthetic [barcode part1]
gtgttactaggcggag

SEQ ID NO: 44800 - DNA, 16 bp, Artificial Sequence
  synthetic [barcode part1]
acgtgagaggtcgttg

SEQ ID NO: 44801 - DNA, 16 bp, Artificial Sequence
  synthetic [barcode part1]
atccgtcgcaagtaac

SEQ ID NO: 44802 - DNA, 16 bp, Artificial Sequence
  synthetic [barcode part1]
cctacaacactattcg

SEQ ID NO: 44803 - DNA, 16 bp, Artificial Sequence
  synthetic [barcode part1]
gttagaccgaactgtc

SEQ ID NO: 44804 - DNA, 16 bp, Artificial Sequence
  synthetic [barcode part1]
tgaggtcaggatcctt

SEQ ID NO: 44805 - DNA, 16 bp, Artificial Sequence
  synthetic [barcode part1]
agtgaatctactcgcg

SEQ ID NO: 44806 - DNA, 16 bp, Artificial Sequence
  synthetic [barcode part1]
tggtctaattcctgtg

SEQ ID NO: 44807 - DNA, 16 bp, Artificial Sequence
  synthetic [barcode part1]
tatctaacgactcctg

SEQ ID NO: 44808 - DNA, 16 bp, Artificial Sequence
  synthetic [barcode part1]
actagaaggccaagag

SEQ ID NO: 44809 - DNA, 16 bp, Artificial Sequence
  synthetic [barcode part1]
cactcacgttcacttc

SEQ ID NO: 44810 - DNA, 16 bp, Artificial Sequence
  synthetic [barcode part1]
cctaaggattggtcgt

SEQ ID NO: 44811 - DNA, 16 bp, Artificial Sequence
  synthetic [barcode part1]
cacacggtgaaggatc

SEQ ID NO: 44812 - DNA, 16 bp, Artificial Sequence
  synthetic [barcode part1]
taagactctgaggcct

SEQ ID NO: 44813 - DNA, 16 bp, Artificial Sequence
  synthetic [barcode part1]
accggatcttaacggt

SEQ ID NO: 44814 - DNA, 16 bp, Artificial Sequence
  synthetic [barcode part1]
acagacttcaggtgtc

SEQ ID NO: 44815 - DNA, 16 bp, Artificial Sequence
  synthetic [barcode part1]
tatacctcaggagtgc

SEQ ID NO: 44816 - DNA, 16 bp, Artificial Sequence
  synthetic [barcode part1]
ttcaactacgccgacc

SEQ ID NO: 44817 - DNA, 16 bp, Artificial Sequence
  synthetic [barcode part1]
gccagacgtgagaatc

SEQ ID NO: 44818 - DNA, 16 bp, Artificial Sequence
  synthetic [barcode part1]
agtgtcgttccagagt

SEQ ID NO: 44819 - DNA, 16 bp, Artificial Sequence
  synthetic [barcode part1]
attgcgaactccgaac

SEQ ID NO: 44820 - DNA, 16 bp, Artificial Sequence
  synthetic [barcode part1]
tgtcggagatagtcct

SEQ ID NO: 44821 - DNA, 16 bp, Artificial Sequence
  synthetic [barcode part1]
ccgcggagatatactt

SEQ ID NO: 44822 - DNA, 16 bp, Artificial Sequence
  synthetic [barcode part1]
cctaacactacacttg

SEQ ID NO: 44823 - DNA, 16 bp, Artificial Sequence
  synthetic [barcode part1]
agagtggtcacaggtc

SEQ ID NO: 44824 - DNA, 16 bp, Artificial Sequence
  synthetic [barcode part1]
ttggacgtaagacagt

SEQ ID NO: 44825 - DNA, 16 bp, Artificial Sequence
  synthetic [barcode part1]
ttacgttctaccagac

SEQ ID NO: 44826 - DNA, 16 bp, Artificial Sequence
  synthetic [barcode part1]
aggtgtgaccaggttg

SEQ ID NO: 44827 - DNA, 16 bp, Artificial Sequence
  synthetic [barcode part1]
acttggaggtaagatc

SEQ ID NO: 44828 - DNA, 16 bp, Artificial Sequence
  synthetic [barcode part1]
agtgtgtggttcctcc

SEQ ID NO: 44829 - DNA, 16 bp, Artificial Sequence
  synthetic [barcode part1]
cctaacacgagttacg

SEQ ID NO: 44830 - DNA, 16 bp, Artificial Sequence
  synthetic [barcode part1]
taggccactctcgtgt

SEQ ID NO: 44831 - DNA, 16 bp, Artificial Sequence
  synthetic [barcode part1]
aacttgccactattcg

SEQ ID NO: 44832 - DNA, 16 bp, Artificial Sequence
  synthetic [barcode part1]
attgacaggtacgcct

SEQ ID NO: 44833 - DNA, 16 bp, Artificial Sequence
  synthetic [barcode part1]
cagacacgtacgactt

SEQ ID NO: 44834 - DNA, 16 bp, Artificial Sequence
  synthetic [barcode part1]
caggattatcaaccgc

SEQ ID NO: 44835 - DNA, 16 bp, Artificial Sequence
  synthetic [barcode part1]
ccaatagagtacagac

SEQ ID NO: 44836 - DNA, 16 bp, Artificial Sequence
  synthetic [barcode part1]
caatcgtcgagagacg

SEQ ID NO: 44837 - DNA, 16 bp, Artificial Sequence
  synthetic [barcode part1]
ttgacttccacgtggc

SEQ ID NO: 44838 - DNA, 16 bp, Artificial Sequence
  synthetic [barcode part1]
accaagtctgtatctc

SEQ ID NO: 44839 - DNA, 16 bp, Artificial Sequence
  synthetic [barcode part1]
taactggtctcggaac

SEQ ID NO: 44840 - DNA, 16 bp, Artificial Sequence
  synthetic [barcode part1]
ttgaggtaacgttgcc

SEQ ID NO: 44841 - DNA, 16 bp, Artificial Sequence
  synthetic [barcode part1]
ttcactaaccgccttc

SEQ ID NO: 44842 - DNA, 16 bp, Artificial Sequence
  synthetic [barcode part1]
tggaacttgatcgacc

SEQ ID NO: 44843 - DNA, 16 bp, Artificial Sequence
  synthetic [barcode part1]
ttgttcaaggttctgc

SEQ ID NO: 44844 - DNA, 16 bp, Artificial Sequence
  synthetic [barcode part1]
gtatagacggattacg

SEQ ID NO: 44845 - DNA, 16 bp, Artificial Sequence
  synthetic [barcode part1]
gcacttaagacttgcg

SEQ ID NO: 44846 - DNA, 16 bp, Artificial Sequence
  synthetic [barcode part1]
atatcctgaccgttac

SEQ ID NO: 44847 - DNA, 16 bp, Artificial Sequence
  synthetic [barcode part1]
tccgaccaatcctctt

SEQ ID NO: 44848 - DNA, 16 bp, Artificial Sequence
  synthetic [barcode part1]
tgtctgtgtggtgcct

SEQ ID NO: 44849 - DNA, 16 bp, Artificial Sequence
  synthetic [barcode part1]
gttccgtcaagttcgc

SEQ ID NO: 44850 - DNA, 16 bp, Artificial Sequence
  synthetic [barcode part1]
gtctagacacttggac

SEQ ID NO: 44851 - DNA, 16 bp, Artificial Sequence
  synthetic [barcode part1]
tattgtacgacgccag

SEQ ID NO: 44852 - DNA, 16 bp, Artificial Sequence
  synthetic [barcode part1]
ttcctctctggtcaac

SEQ ID NO: 44853 - DNA, 16 bp, Artificial Sequence
  synthetic [barcode part1]
tgcaggagattcgacg

SEQ ID NO: 44854 - DNA, 16 bp, Artificial Sequence
  synthetic [barcode part1]
aacgacggtctataag

SEQ ID NO: 44855 - DNA, 16 bp, Artificial Sequence
  synthetic [barcode part1]
gccttaccagaagatc

SEQ ID NO: 44856 - DNA, 16 bp, Artificial Sequence
  synthetic [barcode part1]
gaactgcgaacgtggt

SEQ ID NO: 44857 - DNA, 16 bp, Artificial Sequence
  synthetic [barcode part1]
tggaactaactctggc

SEQ ID NO: 44858 - DNA, 16 bp, Artificial Sequence
  synthetic [barcode part1]
agtctaggaggacacc

SEQ ID NO: 44859 - DNA, 16 bp, Artificial Sequence
  synthetic [barcode part1]
tccggttaccaatatc

SEQ ID NO: 44860 - DNA, 16 bp, Artificial Sequence
  synthetic [barcode part1]
cagacttcgaagtaag

SEQ ID NO: 44861 - DNA, 16 bp, Artificial Sequence
  synthetic [barcode part1]
gtgtgaccaacgtact

SEQ ID NO: 44862 - DNA, 16 bp, Artificial Sequence
  synthetic [barcode part1]
cactaagacctgacac

SEQ ID NO: 44863 - DNA, 16 bp, Artificial Sequence
  synthetic [barcode part1]
taccgaatctagtggc

SEQ ID NO: 44864 - DNA, 16 bp, Artificial Sequence
  synthetic [barcode part1]
tcacaacactgtggtg

SEQ ID NO: 44865 - DNA, 16 bp, Artificial Sequence
  synthetic [barcode part1]
ttgaccttcgtacagt

SEQ ID NO: 44866 - DNA, 16 bp, Artificial Sequence
  synthetic [barcode part1]
ttgtgacgactaaccg

SEQ ID NO: 44867 - DNA, 16 bp, Artificial Sequence
  synthetic [barcode part1]
acttattccgcggcgt

SEQ ID NO: 44868 - DNA, 16 bp, Artificial Sequence
  synthetic [barcode part1]
cctgttctaccgtgag

SEQ ID NO: 44869 - DNA, 16 bp, Artificial Sequence
  synthetic [barcode part1]
cctggtctgatcgtgt

SEQ ID NO: 44870 - DNA, 16 bp, Artificial Sequence
  synthetic [barcode part1]
acgttctgactcaact

SEQ ID NO: 44871 - DNA, 16 bp, Artificial Sequence
  synthetic [barcode part1]
acgagttcttcactac

SEQ ID NO: 44872 - DNA, 16 bp, Artificial Sequence
  synthetic [barcode part1]
tcttcagtaatcgcgt

SEQ ID NO: 44873 - DNA, 16 bp, Artificial Sequence
  synthetic [barcode part1]
aatccgttgagtaccg

SEQ ID NO: 44874 - DNA, 16 bp, Artificial Sequence
  synthetic [barcode part1]
taggtgtcgattcttc

SEQ ID NO: 44875 - DNA, 16 bp, Artificial Sequence
  synthetic [barcode part1]
caatacaggtctgcgt

SEQ ID NO: 44876 - DNA, 16 bp, Artificial Sequence
  synthetic [barcode part1]
aggagtgcgaattgcc

SEQ ID NO: 44877 - DNA, 16 bp, Artificial Sequence
  synthetic [barcode part1]
cgactattgttctacg

SEQ ID NO: 44878 - DNA, 16 bp, Artificial Sequence
  synthetic [barcode part1]
ttccagtgacttacgt

SEQ ID NO: 44879 - DNA, 16 bp, Artificial Sequence
  synthetic [barcode part1]
tacgatcctgacacag

SEQ ID NO: 44880 - DNA, 16 bp, Artificial Sequence
  synthetic [barcode part1]
gtcgatacttgattcc

SEQ ID NO: 44881 - DNA, 16 bp, Artificial Sequence
  synthetic [barcode part1]
ttgacaccaacacgtg

SEQ ID NO: 44882 - DNA, 16 bp, Artificial Sequence
  synthetic [barcode part1]
tgagacggtcttctag

SEQ ID NO: 44883 - DNA, 16 bp, Artificial Sequence
  synthetic [barcode part1]
agtcgatcgtaacacc

SEQ ID NO: 44884 - DNA, 16 bp, Artificial Sequence
  synthetic [barcode part1]
acaacgtaccacagtc

SEQ ID NO: 44885 - DNA, 16 bp, Artificial Sequence
  synthetic [barcode part1]
taccgttgacgcacct

SEQ ID NO: 44886 - DNA, 16 bp, Artificial Sequence
  synthetic [barcode part1]
agtgcgacttgataag

SEQ ID NO: 44887 - DNA, 16 bp, Artificial Sequence
  synthetic [barcode part1]
tctcacaatcggatct

SEQ ID NO: 44888 - DNA, 16 bp, Artificial Sequence
  synthetic [barcode part1]
ttcaggttgccaacag

SEQ ID NO: 44889 - DNA, 16 bp, Artificial Sequence
  synthetic [barcode part1]
cgtaagtgttcacgac

SEQ ID NO: 44890 - DNA, 16 bp, Artificial Sequence
  synthetic [barcode part1]
ttcgactacacgccgt

SEQ ID NO: 44891 - DNA, 16 bp, Artificial Sequence
  synthetic [barcode part1]
aatcttaccgttcacg

SEQ ID NO: 44892 - DNA, 16 bp, Artificial Sequence
  synthetic [barcode part1]
gaattaggcgttaacg

SEQ ID NO: 44893 - DNA, 16 bp, Artificial Sequence
  synthetic [barcode part1]
gacgatcctgacaact

SEQ ID NO: 44894 - DNA, 16 bp, Artificial Sequence
  synthetic [barcode part1]
gaaggtctcctctaag

SEQ ID NO: 44895 - DNA, 16 bp, Artificial Sequence
  synthetic [barcode part1]
actagtacaggaggtt

SEQ ID NO: 44896 - DNA, 16 bp, Artificial Sequence
  synthetic [barcode part1]
gtggcggtatcgatag

SEQ ID NO: 44897 - DNA, 16 bp, Artificial Sequence
  synthetic [barcode part1]
gtgcgtatacgacgtt

SEQ ID NO: 44898 - DNA, 16 bp, Artificial Sequence
  synthetic [barcode part1]
accgtatccgatacag

SEQ ID NO: 44899 - DNA, 16 bp, Artificial Sequence
  synthetic [barcode part1]
gatacgcagagaatct

SEQ ID NO: 44900 - DNA, 16 bp, Artificial Sequence
  synthetic [barcode part1]
gccttaaggccttaag

SEQ ID NO: 44901 - DNA, 16 bp, Artificial Sequence
  synthetic [barcode part1]
aacgtgcaatcctctt

SEQ ID NO: 44902 - DNA, 16 bp, Artificial Sequence
  synthetic [barcode part1]
gtctcgtctactgttc

SEQ ID NO: 44903 - DNA, 16 bp, Artificial Sequence
  synthetic [barcode part1]
tgcactcgttcttgtc

SEQ ID NO: 44904 - DNA, 16 bp, Artificial Sequence
  synthetic [barcode part1]
tgaataggcagtgttg

SEQ ID NO: 44905 - DNA, 16 bp, Artificial Sequence
  synthetic [barcode part1]
gcgtatactgattggc

SEQ ID NO: 44906 - DNA, 16 bp, Artificial Sequence
  synthetic [barcode part1]
ccgatatctccttaag

SEQ ID NO: 44907 - DNA, 16 bp, Artificial Sequence
  synthetic [barcode part1]
aacaccagttgcaacc

SEQ ID NO: 44908 - DNA, 16 bp, Artificial Sequence
  synthetic [barcode part1]
tacgtcacaaccacag

SEQ ID NO: 44909 - DNA, 16 bp, Artificial Sequence
  synthetic [barcode part1]
ttctcgagtgtgttgt

SEQ ID NO: 44910 - DNA, 16 bp, Artificial Sequence
  synthetic [barcode part1]
acgttaacggcggagt

SEQ ID NO: 44911 - DNA, 16 bp, Artificial Sequence
  synthetic [barcode part1]
ccggatcggttattag

SEQ ID NO: 44912 - DNA, 16 bp, Artificial Sequence
  synthetic [barcode part1]
taatccgcctgtgtcg

SEQ ID NO: 44913 - DNA, 16 bp, Artificial Sequence
  synthetic [barcode part1]
gtcaatccttccttcg

SEQ ID NO: 44914 - DNA, 16 bp, Artificial Sequence
  synthetic [barcode part1]
cgtctctccagatcag

SEQ ID NO: 44915 - DNA, 16 bp, Artificial Sequence
  synthetic [barcode part1]
ttcggccgttgtgtgt

SEQ ID NO: 44916 - DNA, 16 bp, Artificial Sequence
  synthetic [barcode part1]
cacacggcactaatac

SEQ ID NO: 44917 - DNA, 16 bp, Artificial Sequence
  synthetic [barcode part1]
tactggagtgagaatc

SEQ ID NO: 44918 - DNA, 16 bp, Artificial Sequence
  synthetic [barcode part1]
tgacgccttatccgtg

SEQ ID NO: 44919 - DNA, 16 bp, Artificial Sequence
  synthetic [barcode part1]
tctcggcctagtacgt

SEQ ID NO: 44920 - DNA, 16 bp, Artificial Sequence
  synthetic [barcode part1]
ttaaggacgcaagttg

SEQ ID NO: 44921 - DNA, 16 bp, Artificial Sequence
  synthetic [barcode part1]
gcctcgtctcaatctt

SEQ ID NO: 44922 - DNA, 16 bp, Artificial Sequence
  synthetic [barcode part1]
atcgagtcctgcgttc

SEQ ID NO: 44923 - DNA, 16 bp, Artificial Sequence
  synthetic [barcode part1]
taccgcgagaattctg

SEQ ID NO: 44924 - DNA, 16 bp, Artificial Sequence
  synthetic [barcode part1]
gaattagtagtgcacg

SEQ ID NO: 44925 - DNA, 16 bp, Artificial Sequence
  synthetic [barcode part1]
ccagaccaatctaacg

SEQ ID NO: 44926 - DNA, 16 bp, Artificial Sequence
  synthetic [barcode part1]
gatcgttggcacagag

SEQ ID NO: 44927 - DNA, 16 bp, Artificial Sequence
  synthetic [barcode part1]
accgaacaacgcgagt

SEQ ID NO: 44928 - DNA, 16 bp, Artificial Sequence
  synthetic [barcode part1]
cagattctgttgttcg

SEQ ID NO: 44929 - DNA, 16 bp, Artificial Sequence
  synthetic [barcode part1]
cctcttggatatactg

SEQ ID NO: 44930 - DNA, 16 bp, Artificial Sequence
  synthetic [barcode part1]
aagtgcctggaatagt

SEQ ID NO: 44931 - DNA, 16 bp, Artificial Sequence
  synthetic [barcode part1]
caagtgttaatcctcc

SEQ ID NO: 44932 - DNA, 16 bp, Artificial Sequence
  synthetic [barcode part1]
acgtggttgtgcgatt

SEQ ID NO: 44933 - DNA, 16 bp, Artificial Sequence
  synthetic [barcode part1]
acttgtcgtggtatct

SEQ ID NO: 44934 - DNA, 16 bp, Artificial Sequence
  synthetic [barcode part1]
tgttactggcggtaac

SEQ ID NO: 44935 - DNA, 16 bp, Artificial Sequence
  synthetic [barcode part1]
gagttacagtgacctc

SEQ ID NO: 44936 - DNA, 16 bp, Artificial Sequence
  synthetic [barcode part1]
tcgcgagtagattcac

SEQ ID NO: 44937 - DNA, 16 bp, Artificial Sequence
  synthetic [barcode part1]
gccaacagaatcaagt

SEQ ID NO: 44938 - DNA, 16 bp, Artificial Sequence
  synthetic [barcode part1]
atctcgagatcggttg

SEQ ID NO: 44939 - DNA, 16 bp, Artificial Sequence
  synthetic [barcode part1]
gatcgattgacgtcac

SEQ ID NO: 44940 - DNA, 16 bp, Artificial Sequence
  synthetic [barcode part1]
ccttcgaggagttaac

SEQ ID NO: 44941 - DNA, 16 bp, Artificial Sequence
  synthetic [barcode part1]
agactattcgcgttct

SEQ ID NO: 44942 - DNA, 16 bp, Artificial Sequence
  synthetic [barcode part1]
tccgaccaccgatact

SEQ ID NO: 44943 - DNA, 16 bp, Artificial Sequence
  synthetic [barcode part1]
accacggaacaagtgc

SEQ ID NO: 44944 - DNA, 16 bp, Artificial Sequence
  synthetic [barcode part1]
ttgttactctaccgcc

SEQ ID NO: 44945 - DNA, 16 bp, Artificial Sequence
  synthetic [barcode part1]
ccgaataggtaaggcc

SEQ ID NO: 44946 - DNA, 16 bp, Artificial Sequence
  synthetic [barcode part1]
aacacacaccaacgtc

SEQ ID NO: 44947 - DNA, 16 bp, Artificial Sequence
  synthetic [barcode part1]
tcgcaataggaggaag

SEQ ID NO: 44948 - DNA, 16 bp, Artificial Sequence
  synthetic [barcode part1]
tcctcactgaaccgtg

SEQ ID NO: 44949 - DNA, 16 bp, Artificial Sequence
  synthetic [barcode part1]
ttcgaggcgatcaact

SEQ ID NO: 44950 - DNA, 16 bp, Artificial Sequence
  synthetic [barcode part1]
tgaggtcttcctctct

SEQ ID NO: 44951 - DNA, 16 bp, Artificial Sequence
  synthetic [barcode part1]
tgcaacgccactcgtt

SEQ ID NO: 44952 - DNA, 16 bp, Artificial Sequence
  synthetic [barcode part1]
ttatccacctacctgc

SEQ ID NO: 44953 - DNA, 16 bp, Artificial Sequence
  synthetic [barcode part1]
tccgagatcggaatct

SEQ ID NO: 44954 - DNA, 16 bp, Artificial Sequence
  synthetic [barcode part1]
ttggacgcgttgtcct

SEQ ID NO: 44955 - DNA, 16 bp, Artificial Sequence
  synthetic [barcode part1]
gactctcgattatacc

SEQ ID NO: 44956 - DNA, 16 bp, Artificial Sequence
  synthetic [barcode part1]
cgattctatcgcgcgt

SEQ ID NO: 44957 - DNA, 16 bp, Artificial Sequence
  synthetic [barcode part1]
attcggtaatccgacg

SEQ ID NO: 44958 - DNA, 16 bp, Artificial Sequence
  synthetic [barcode part1]
cgtcttcgccagattg

SEQ ID NO: 44959 - DNA, 16 bp, Artificial Sequence
  synthetic [barcode part1]
attcaagtccgtcgtt

SEQ ID NO: 44960 - DNA, 16 bp, Artificial Sequence
  synthetic [barcode part1]
gtgatcggatcttctt

SEQ ID NO: 44961 - DNA, 16 bp, Artificial Sequence
  synthetic [barcode part1]
gcgagagtctcgtatt

SEQ ID NO: 44962 - DNA, 16 bp, Artificial Sequence
  synthetic [barcode part1]
agaaccgcaattctcg

SEQ ID NO: 44963 - DNA, 16 bp, Artificial Sequence
  synthetic [barcode part1]
cgtagtgtacttacct

SEQ ID NO: 44964 - DNA, 16 bp, Artificial Sequence
  synthetic [barcode part1]
gtgccaacctccgatt

SEQ ID NO: 44965 - DNA, 16 bp, Artificial Sequence
  synthetic [barcode part1]
gcctctaagaccgttc

SEQ ID NO: 44966 - DNA, 16 bp, Artificial Sequence
  synthetic [barcode part1]
tatctcttctcgcacg

SEQ ID NO: 44967 - DNA, 16 bp, Artificial Sequence
  synthetic [barcode part1]
cacacgagagtgtctt

SEQ ID NO: 44968 - DNA, 16 bp, Artificial Sequence
  synthetic [barcode part1]
attacctaggcggtac

SEQ ID NO: 44969 - DNA, 16 bp, Artificial Sequence
  synthetic [barcode part1]
agtcaatacgcgcgtt

SEQ ID NO: 44970 - DNA, 16 bp, Artificial Sequence
  synthetic [barcode part1]
gtcactcagatccacc

SEQ ID NO: 44971 - DNA, 16 bp, Artificial Sequence
  synthetic [barcode part1]
gtgtcgagatcacact

SEQ ID NO: 44972 - DNA, 16 bp, Artificial Sequence
  synthetic [barcode part1]
cagttacctatcgccg

SEQ ID NO: 44973 - DNA, 16 bp, Artificial Sequence
  synthetic [barcode part1]
gtatattctcagtccg

SEQ ID NO: 44974 - DNA, 16 bp, Artificial Sequence
  synthetic [barcode part1]
gtatcgtcttgtctag

SEQ ID NO: 44975 - DNA, 16 bp, Artificial Sequence
  synthetic [barcode part1]
gacctgcacgatagag

SEQ ID NO: 44976 - DNA, 16 bp, Artificial Sequence
  synthetic [barcode part1]
aattgcggagatcaac

SEQ ID NO: 44977 - DNA, 16 bp, Artificial Sequence
  synthetic [barcode part1]
aagactcgataggcgc

SEQ ID NO: 44978 - DNA, 16 bp, Artificial Sequence
  synthetic [barcode part1]
aggacacctagtgacg

SEQ ID NO: 44979 - DNA, 16 bp, Artificial Sequence
  synthetic [barcode part1]
attcgcagttagagag

SEQ ID NO: 44980 - DNA, 16 bp, Artificial Sequence
  synthetic [barcode part1]
tatcctgattcacggt

SEQ ID NO: 44981 - DNA, 16 bp, Artificial Sequence
  synthetic [barcode part1]
cagttgtaggttgaag

SEQ ID NO: 44982 - DNA, 16 bp, Artificial Sequence
  synthetic [barcode part1]
tccggaattgatcggt

SEQ ID NO: 44983 - DNA, 16 bp, Artificial Sequence
  synthetic [barcode part1]
aacgcaccttcttagt

SEQ ID NO: 44984 - DNA, 16 bp, Artificial Sequence
  synthetic [barcode part1]
acgacgaagtgcgttg

SEQ ID NO: 44985 - DNA, 16 bp, Artificial Sequence
  synthetic [barcode part1]
gtaccaggcacttagt

SEQ ID NO: 44986 - DNA, 16 bp, Artificial Sequence
  synthetic [barcode part1]
tatccacgcaacactt

SEQ ID NO: 44987 - DNA, 16 bp, Artificial Sequence
  synthetic [barcode part1]
aacctactgtcacttg

SEQ ID NO: 44988 - DNA, 16 bp, Artificial Sequence
  synthetic [barcode part1]
tcagataccgcagact

SEQ ID NO: 44989 - DNA, 16 bp, Artificial Sequence
  synthetic [barcode part1]
gaggacacgaactgtc

SEQ ID NO: 44990 - DNA, 16 bp, Artificial Sequence
  synthetic [barcode part1]
cactgttccgtgtggt

SEQ ID NO: 44991 - DNA, 16 bp, Artificial Sequence
  synthetic [barcode part1]
cgcactcaagttatct

SEQ ID NO: 44992 - DNA, 16 bp, Artificial Sequence
  synthetic [barcode part1]
caattctatcggtacc

SEQ ID NO: 44993 - DNA, 16 bp, Artificial Sequence
  synthetic [barcode part1]
accactacgcaccttg

SEQ ID NO: 44994 - DNA, 16 bp, Artificial Sequence
  synthetic [barcode part1]
tcacttagaacttcgc

SEQ ID NO: 44995 - DNA, 16 bp, Artificial Sequence
  synthetic [barcode part1]
cggcggtaacttgatt

SEQ ID NO: 44996 - DNA, 16 bp, Artificial Sequence
  synthetic [barcode part1]
tgtctgtgttcgtcct

SEQ ID NO: 44997 - DNA, 16 bp, Artificial Sequence
  synthetic [barcode part1]
agtctacgtcttgccg

SEQ ID NO: 44998 - DNA, 16 bp, Artificial Sequence
  synthetic [barcode part1]
tctcggtgtataactc

SEQ ID NO: 44999 - DNA, 16 bp, Artificial Sequence
  synthetic [barcode part1]
aacgagatacaggtct

SEQ ID NO: 45000 - DNA, 16 bp, Artificial Sequence
  synthetic [barcode part1]
tagttggactggtcac

SEQ ID NO: 45001 - DNA, 16 bp, Artificial Sequence
  synthetic [barcode part1]
gattcacggacggtag

SEQ ID NO: 45002 - DNA, 16 bp, Artificial Sequence
  synthetic [barcode part1]
gtgtcggactacttcc

SEQ ID NO: 45003 - DNA, 16 bp, Artificial Sequence
  synthetic [barcode part1]
tacgcctcttaacaac

SEQ ID NO: 45004 - DNA, 16 bp, Artificial Sequence
  synthetic [barcode part1]
acggtattcggagttc

SEQ ID NO: 45005 - DNA, 16 bp, Artificial Sequence
  synthetic [barcode part1]
atagttaaggatcggc

SEQ ID NO: 45006 - DNA, 16 bp, Artificial Sequence
  synthetic [barcode part1]
gcgaagtggcacttag

SEQ ID NO: 45007 - DNA, 16 bp, Artificial Sequence
  synthetic [barcode part1]
cgcgaattctgccgtt

SEQ ID NO: 45008 - DNA, 16 bp, Artificial Sequence
  synthetic [barcode part1]
tggagagtgatacgcc

SEQ ID NO: 45009 - DNA, 16 bp, Artificial Sequence
  synthetic [barcode part1]
tggaagagtacactgt

SEQ ID NO: 45010 - DNA, 16 bp, Artificial Sequence
  synthetic [barcode part1]
ccttctgtccaacttg

SEQ ID NO: 45011 - DNA, 16 bp, Artificial Sequence
  synthetic [barcode part1]
gagttcacctgtgaac

SEQ ID NO: 45012 - DNA, 16 bp, Artificial Sequence
  synthetic [barcode part1]
gtgtggtgtgtgttgt

SEQ ID NO: 45013 - DNA, 16 bp, Artificial Sequence
  synthetic [barcode part1]
cagttcaacttccgcg

SEQ ID NO: 45014 - DNA, 16 bp, Artificial Sequence
  synthetic [barcode part1]
gtctcggattgactag

SEQ ID NO: 45015 - DNA, 16 bp, Artificial Sequence
  synthetic [barcode part1]
ttggcgaggactactt

SEQ ID NO: 45016 - DNA, 16 bp, Artificial Sequence
  synthetic [barcode part1]
cgcagaagtcaccaag

SEQ ID NO: 45017 - DNA, 16 bp, Artificial Sequence
  synthetic [barcode part1]
tacggttgactcacag

SEQ ID NO: 45018 - DNA, 16 bp, Artificial Sequence
  synthetic [barcode part1]
tgtctccttaacagtg

SEQ ID NO: 45019 - DNA, 16 bp, Artificial Sequence
  synthetic [barcode part1]
cgattagagttccgac

SEQ ID NO: 45020 - DNA, 16 bp, Artificial Sequence
  synthetic [barcode part1]
aagacgatcgcggact

SEQ ID NO: 45021 - DNA, 16 bp, Artificial Sequence
  synthetic [barcode part1]
tgcgtgatccgactct

SEQ ID NO: 45022 - DNA, 16 bp, Artificial Sequence
  synthetic [barcode part1]
tcggacgtctgttgtc

SEQ ID NO: 45023 - DNA, 16 bp, Artificial Sequence
  synthetic [barcode part1]
tcagactccggattag

SEQ ID NO: 45024 - DNA, 16 bp, Artificial Sequence
  synthetic [barcode part1]
gtgttagtcggatacc

SEQ ID NO: 45025 - DNA, 16 bp, Artificial Sequence
  synthetic [barcode part1]
cgcaggcaagtagtgt

SEQ ID NO: 45026 - DNA, 16 bp, Artificial Sequence
  synthetic [barcode part1]
gtgccaaggagactgt

SEQ ID NO: 45027 - DNA, 16 bp, Artificial Sequence
  synthetic [barcode part1]
ttgttgtagactcacc

SEQ ID NO: 45028 - DNA, 16 bp, Artificial Sequence
  synthetic [barcode part1]
agagtctcggaattcc

SEQ ID NO: 45029 - DNA, 16 bp, Artificial Sequence
  synthetic [barcode part1]
gcgtcgtacaatactg

SEQ ID NO: 45030 - DNA, 16 bp, Artificial Sequence
  synthetic [barcode part1]
actagtgcaccaacac

SEQ ID NO: 45031 - DNA, 16 bp, Artificial Sequence
  synthetic [barcode part1]
tcaaggccgttcacct

SEQ ID NO: 45032 - DNA, 16 bp, Artificial Sequence
  synthetic [barcode part1]
cacttcgtcgttctac

SEQ ID NO: 45033 - DNA, 16 bp, Artificial Sequence
  synthetic [barcode part1]
ataatctcctgtgtcg

SEQ ID NO: 45034 - DNA, 16 bp, Artificial Sequence
  synthetic [barcode part1]
gagaattatcggtacg

SEQ ID NO: 45035 - DNA, 16 bp, Artificial Sequence
  synthetic [barcode part1]
attagaggaccttccg

SEQ ID NO: 45036 - DNA, 16 bp, Artificial Sequence
  synthetic [barcode part1]
gtatcgtatagacgag

SEQ ID NO: 45037 - DNA, 16 bp, Artificial Sequence
  synthetic [barcode part1]
attcgtcgagtggact

SEQ ID NO: 45038 - DNA, 16 bp, Artificial Sequence
  synthetic [barcode part1]
caccgccacaattgtc

SEQ ID NO: 45039 - DNA, 16 bp, Artificial Sequence
  synthetic [barcode part1]
tccgcgttaacggtct

SEQ ID NO: 45040 - DNA, 16 bp, Artificial Sequence
  synthetic [barcode part1]
agtgaccaatccgact

SEQ ID NO: 45041 - DNA, 16 bp, Artificial Sequence
  synthetic [barcode part1]
gccggttagaattctg

SEQ ID NO: 45042 - DNA, 16 bp, Artificial Sequence
  synthetic [barcode part1]
accaccgtgataactg

SEQ ID NO: 45043 - DNA, 16 bp, Artificial Sequence
  synthetic [barcode part1]
tgtacacaaccagtcg

SEQ ID NO: 45044 - DNA, 16 bp, Artificial Sequence
  synthetic [barcode part1]
attaggaccagttccg

SEQ ID NO: 45045 - DNA, 16 bp, Artificial Sequence
  synthetic [barcode part1]
atcacctcggagtagt

SEQ ID NO: 45046 - DNA, 16 bp, Artificial Sequence
  synthetic [barcode part1]
acaaccacctcggttc

SEQ ID NO: 45047 - DNA, 16 bp, Artificial Sequence
  synthetic [barcode part1]
gtaccgaagagtaact

SEQ ID NO: 45048 - DNA, 16 bp, Artificial Sequence
  synthetic [barcode part1]
actgtgtcagttcttg

SEQ ID NO: 45049 - DNA, 16 bp, Artificial Sequence
  synthetic [barcode part1]
gataggcagatcttag

SEQ ID NO: 45050 - DNA, 16 bp, Artificial Sequence
  synthetic [barcode part1]
ttacacttcgtcgaac

SEQ ID NO: 45051 - DNA, 16 bp, Artificial Sequence
  synthetic [barcode part1]
cagagtctgcaacgtt

SEQ ID NO: 45052 - DNA, 16 bp, Artificial Sequence
  synthetic [barcode part1]
ttgttatcaggcgtct

SEQ ID NO: 45053 - DNA, 16 bp, Artificial Sequence
  synthetic [barcode part1]
aggatctaataggtgc

SEQ ID NO: 45054 - DNA, 16 bp, Artificial Sequence
  synthetic [barcode part1]
cgagatcactgcagtt

SEQ ID NO: 45055 - DNA, 16 bp, Artificial Sequence
  synthetic [barcode part1]
cctccagtgattgcgt

SEQ ID NO: 45056 - DNA, 16 bp, Artificial Sequence
  synthetic [barcode part1]
tggagaggaagaatcc

SEQ ID NO: 45057 - DNA, 16 bp, Artificial Sequence
  synthetic [barcode part1]
tataccgtaacgcacg

SEQ ID NO: 45058 - DNA, 16 bp, Artificial Sequence
  synthetic [barcode part1]
agatcgtgcagtctac

SEQ ID NO: 45059 - DNA, 16 bp, Artificial Sequence
  synthetic [barcode part1]
tgagtctgcgacgaag

SEQ ID NO: 45060 - DNA, 16 bp, Artificial Sequence
  synthetic [barcode part1]
acactggaaggtgatt

SEQ ID NO: 45061 - DNA, 16 bp, Artificial Sequence
  synthetic [barcode part1]
gtcaacacgagaggtc

SEQ ID NO: 45062 - DNA, 16 bp, Artificial Sequence
  synthetic [barcode part1]
ttgcctgtccgagatc

SEQ ID NO: 45063 - DNA, 16 bp, Artificial Sequence
  synthetic [barcode part1]
gtgagaatcgacaact

SEQ ID NO: 45064 - DNA, 16 bp, Artificial Sequence
  synthetic [barcode part1]
caatataacgtccggc

SEQ ID NO: 45065 - DNA, 16 bp, Artificial Sequence
  synthetic [barcode part1]
aggtatagacttgacg

SEQ ID NO: 45066 - DNA, 16 bp, Artificial Sequence
  synthetic [barcode part1]
ttggtccacaggatac

SEQ ID NO: 45067 - DNA, 16 bp, Artificial Sequence
  synthetic [barcode part1]
gttgaactactggacc

SEQ ID NO: 45068 - DNA, 16 bp, Artificial Sequence
  synthetic [barcode part1]
cgaagtccacagtact

SEQ ID NO: 45069 - DNA, 16 bp, Artificial Sequence
  synthetic [barcode part1]
gtcgaagtagtgcgtg

SEQ ID NO: 45070 - DNA, 16 bp, Artificial Sequence
  synthetic [barcode part1]
aagtcgtgtggaggtc

SEQ ID NO: 45071 - DNA, 16 bp, Artificial Sequence
  synthetic [barcode part1]
gtcttgcgtggttacc

SEQ ID NO: 45072 - DNA, 16 bp, Artificial Sequence
  synthetic [barcode part1]
caggtgacttaggacg

SEQ ID NO: 45073 - DNA, 16 bp, Artificial Sequence
  synthetic [barcode part1]
aagagtagacgtaggc

SEQ ID NO: 45074 - DNA, 16 bp, Artificial Sequence
  synthetic [barcode part1]
gacgcacttccaactc

SEQ ID NO: 45075 - DNA, 16 bp, Artificial Sequence
  synthetic [barcode part1]
tgacactataggcaag

SEQ ID NO: 45076 - DNA, 16 bp, Artificial Sequence
  synthetic [barcode part1]
tgaaggaattgcacgt

SEQ ID NO: 45077 - DNA, 16 bp, Artificial Sequence
  synthetic [barcode part1]
aatagagaatctgcgc

SEQ ID NO: 45078 - DNA, 16 bp, Artificial Sequence
  synthetic [barcode part1]
gttcgtccttacctac

SEQ ID NO: 45079 - DNA, 16 bp, Artificial Sequence
  synthetic [barcode part1]
caatccacgccttcag

SEQ ID NO: 45080 - DNA, 16 bp, Artificial Sequence
  synthetic [barcode part1]
ttaccttccgatacag

SEQ ID NO: 45081 - DNA, 16 bp, Artificial Sequence
  synthetic [barcode part1]
ttctgtgcagtaacct

SEQ ID NO: 45082 - DNA, 16 bp, Artificial Sequence
  synthetic [barcode part1]
gtccactcctagaacc

SEQ ID NO: 45083 - DNA, 16 bp, Artificial Sequence
  synthetic [barcode part1]
aacctactctgccgtg

SEQ ID NO: 45084 - DNA, 16 bp, Artificial Sequence
  synthetic [barcode part1]
cggtaccaagtgaacg

SEQ ID NO: 45085 - DNA, 16 bp, Artificial Sequence
  synthetic [barcode part1]
aaggtaacaggacgac

SEQ ID NO: 45086 - DNA, 16 bp, Artificial Sequence
  synthetic [barcode part1]
aagaatcctggccttg

SEQ ID NO: 45087 - DNA, 16 bp, Artificial Sequence
  synthetic [barcode part1]
gtccaatatacctctg

SEQ ID NO: 45088 - DNA, 16 bp, Artificial Sequence
  synthetic [barcode part1]
gccgataggcaacagt

SEQ ID NO: 45089 - DNA, 16 bp, Artificial Sequence
  synthetic [barcode part1]
tgttgcaacgtacgtg

SEQ ID NO: 45090 - DNA, 16 bp, Artificial Sequence
  synthetic [barcode part1]
attccgtaacggcagt

SEQ ID NO: 45091 - DNA, 16 bp, Artificial Sequence
  synthetic [barcode part1]
tctgccagtattcggc

SEQ ID NO: 45092 - DNA, 16 bp, Artificial Sequence
  synthetic [barcode part1]
gtacggagaattatcg

SEQ ID NO: 45093 - DNA, 16 bp, Artificial Sequence
  synthetic [barcode part1]
tacaacctacgtcgag

SEQ ID NO: 45094 - DNA, 16 bp, Artificial Sequence
  synthetic [barcode part1]
tacagacgaactcgtc

SEQ ID NO: 45095 - DNA, 16 bp, Artificial Sequence
  synthetic [barcode part1]
cagattgcgcactctc

SEQ ID NO: 45096 - DNA, 16 bp, Artificial Sequence
  synthetic [barcode part1]
tgttcgtacctcaagt

SEQ ID NO: 45097 - DNA, 16 bp, Artificial Sequence
  synthetic [barcode part1]
gccttaagaggaagag

SEQ ID NO: 45098 - DNA, 16 bp, Artificial Sequence
  synthetic [barcode part1]
cggaactaaggtcctt

SEQ ID NO: 45099 - DNA, 16 bp, Artificial Sequence
  synthetic [barcode part1]
ccaacaggtaggaatt

SEQ ID NO: 45100 - DNA, 16 bp, Artificial Sequence
  synthetic [barcode part1]
cctgattccgatcctt

SEQ ID NO: 45101 - DNA, 16 bp, Artificial Sequence
  synthetic [barcode part1]
tgccttctaacctaag

SEQ ID NO: 45102 - DNA, 16 bp, Artificial Sequence
  synthetic [barcode part1]
gcaactgcgtaatcgt

SEQ ID NO: 45103 - DNA, 16 bp, Artificial Sequence
  synthetic [barcode part1]
acagtatacgcgcgtt

SEQ ID NO: 45104 - DNA, 16 bp, Artificial Sequence
  synthetic [barcode part1]
cagtgtaggaagtcgc

SEQ ID NO: 45105 - DNA, 16 bp, Artificial Sequence
  synthetic [barcode part1]
gacgtcaacacgtact

SEQ ID NO: 45106 - DNA, 16 bp, Artificial Sequence
  synthetic [barcode part1]
gaactggcgcagttag

SEQ ID NO: 45107 - DNA, 16 bp, Artificial Sequence
  synthetic [barcode part1]
ttaatagtgtcctcgc

SEQ ID NO: 45108 - DNA, 16 bp, Artificial Sequence
  synthetic [barcode part1]
cgttgagttacacctt

SEQ ID NO: 45109 - DNA, 16 bp, Artificial Sequence
  synthetic [barcode part1]
ttggagtggcggatac

SEQ ID NO: 45110 - DNA, 16 bp, Artificial Sequence
  synthetic [barcode part1]
tcacttattacgacgc

SEQ ID NO: 45111 - DNA, 16 bp, Artificial Sequence
  synthetic [barcode part1]
gaatctggcagagtgc

SEQ ID NO: 45112 - DNA, 16 bp, Artificial Sequence
  synthetic [barcode part1]
gtcttgccgagtctac

SEQ ID NO: 45113 - DNA, 16 bp, Artificial Sequence
  synthetic [barcode part1]
ataccgttgttcgccg

SEQ ID NO: 45114 - DNA, 16 bp, Artificial Sequence
  synthetic [barcode part1]
ccggaacttgtagtac

SEQ ID NO: 45115 - DNA, 16 bp, Artificial Sequence
  synthetic [barcode part1]
cgtcgagatccaatac

SEQ ID NO: 45116 - DNA, 16 bp, Artificial Sequence
  synthetic [barcode part1]
cgacacaggagtaatt

SEQ ID NO: 45117 - DNA, 16 bp, Artificial Sequence
  synthetic [barcode part1]
ttctatccgtcgttcg

SEQ ID NO: 45118 - DNA, 16 bp, Artificial Sequence
  synthetic [barcode part1]
acggaagtcggactac

SEQ ID NO: 45119 - DNA, 16 bp, Artificial Sequence
  synthetic [barcode part1]
attctcggagttacct

SEQ ID NO: 45120 - DNA, 16 bp, Artificial Sequence
  synthetic [barcode part1]
ccgaatattaccttgc

SEQ ID NO: 45121 - DNA, 16 bp, Artificial Sequence
  synthetic [barcode part1]
aggtggttggtaagag

SEQ ID NO: 45122 - DNA, 16 bp, Artificial Sequence
  synthetic [barcode part1]
tcacagtaccacaacg

SEQ ID NO: 45123 - DNA, 16 bp, Artificial Sequence
  synthetic [barcode part1]
acggagtacagtagag

SEQ ID NO: 45124 - DNA, 16 bp, Artificial Sequence
  synthetic [barcode part1]
gagtcagtggttatag

SEQ ID NO: 45125 - DNA, 16 bp, Artificial Sequence
  synthetic [barcode part1]
ttaacgacctgtacct

SEQ ID NO: 45126 - DNA, 16 bp, Artificial Sequence
  synthetic [barcode part1]
acaacgtgttgactgc

SEQ ID NO: 45127 - DNA, 12 bp, Artificial Sequence
  synthetic [barcode part2]
agtcgtgccgat

SEQ ID NO: 45128 - DNA, 12 bp, Artificial Sequence
  synthetic [barcode part2]
tgccaatagttg

SEQ ID NO: 45129 - DNA, 12 bp, Artificial Sequence
  synthetic [barcode part2]
caatgcgcgact

SEQ ID NO: 45130 - DNA, 12 bp, Artificial Sequence
  synthetic [barcode part2]
atgaactaccgt

SEQ ID NO: 45131 - DNA, 12 bp, Artificial Sequence
  synthetic [barcode part2]
acaccgacgact

SEQ ID NO: 45132 - DNA, 12 bp, Artificial Sequence
  synthetic [barcode part2]
aatcgtgtcaac

SEQ ID NO: 45133 - DNA, 12 bp, Artificial Sequence
  synthetic [barcode part2]
tcgagttgtatg

SEQ ID NO: 45134 - DNA, 12 bp, Artificial Sequence
  synthetic [barcode part2]
ttctagtgtcgc

SEQ ID NO: 45135 - DNA, 12 bp, Artificial Sequence
  synthetic [barcode part2]
ttcaatctcggc

SEQ ID NO: 45136 - DNA, 12 bp, Artificial Sequence
  synthetic [barcode part2]
ccaacatggtcg

SEQ ID NO: 45137 - DNA, 12 bp, Artificial Sequence
  synthetic [barcode part2]
atgatcaccagt

SEQ ID NO: 45138 - DNA, 12 bp, Artificial Sequence
  synthetic [barcode part2]
tctagttccgac

SEQ ID NO: 45139 - DNA, 12 bp, Artificial Sequence
  synthetic [barcode part2]
taatctctcggc

SEQ ID NO: 45140 - DNA, 12 bp, Artificial Sequence
  synthetic [barcode part2]
ttctgtacgcac

SEQ ID NO: 45141 - DNA, 12 bp, Artificial Sequence
  synthetic [barcode part2]
tcttgcgatgtc

SEQ ID NO: 45142 - DNA, 12 bp, Artificial Sequence
  synthetic [barcode part2]
cacaccgaactg

SEQ ID NO: 45143 - DNA, 12 bp, Artificial Sequence
  synthetic [barcode part2]
tcggattgtgcg

SEQ ID NO: 45144 - DNA, 12 bp, Artificial Sequence
  synthetic [barcode part2]
taacgcacaatc

SEQ ID NO: 45145 - DNA, 12 bp, Artificial Sequence
  synthetic [barcode part2]
caacttctcggt

SEQ ID NO: 45146 - DNA, 12 bp, Artificial Sequence
  synthetic [barcode part2]
agtctggtgcgt

SEQ ID NO: 45147 - DNA, 12 bp, Artificial Sequence
  synthetic [barcode part2]
caacggtcacgt

SEQ ID NO: 45148 - DNA, 12 bp, Artificial Sequence
  synthetic [barcode part2]
attgcaccgacg

SEQ ID NO: 45149 - DNA, 12 bp, Artificial Sequence
  synthetic [barcode part2]
ttcgccagttac

SEQ ID NO: 45150 - DNA, 12 bp, Artificial Sequence
  synthetic [barcode part2]
aacggtccatat

SEQ ID NO: 45151 - DNA, 12 bp, Artificial Sequence
  synthetic [barcode part2]
tagaccgcatat

SEQ ID NO: 45152 - DNA, 12 bp, Artificial Sequence
  synthetic [barcode part2]
ataccgacaatc

SEQ ID NO: 45153 - DNA, 12 bp, Artificial Sequence
  synthetic [barcode part2]
atgtgatctggt

SEQ ID NO: 45154 - DNA, 12 bp, Artificial Sequence
  synthetic [barcode part2]
atacttcgcgtc

SEQ ID NO: 45155 - DNA, 12 bp, Artificial Sequence
  synthetic [barcode part2]
tatgcgtctctg

SEQ ID NO: 45156 - DNA, 12 bp, Artificial Sequence
  synthetic [barcode part2]
caagtgccgact

SEQ ID NO: 45157 - DNA, 12 bp, Artificial Sequence
  synthetic [barcode part2]
tccggtcttagt

SEQ ID NO: 45158 - DNA, 12 bp, Artificial Sequence
  synthetic [barcode part2]
cgtacatcttcg

SEQ ID NO: 45159 - DNA, 12 bp, Artificial Sequence
  synthetic [barcode part2]
tggatacaccgc

SEQ ID NO: 45160 - DNA, 12 bp, Artificial Sequence
  synthetic [barcode part2]
tcgtagtcttcg

SEQ ID NO: 45161 - DNA, 12 bp, Artificial Sequence
  synthetic [barcode part2]
aatggtctatgc

SEQ ID NO: 45162 - DNA, 12 bp, Artificial Sequence
  synthetic [barcode part2]
cgatggccatac

SEQ ID NO: 45163 - DNA, 12 bp, Artificial Sequence
  synthetic [barcode part2]
acgaccggattc

SEQ ID NO: 45164 - DNA, 12 bp, Artificial Sequence
  synthetic [barcode part2]
tgcgagaacatg

SEQ ID NO: 45165 - DNA, 12 bp, Artificial Sequence
  synthetic [barcode part2]
cgtgtattctcg

SEQ ID NO: 45166 - DNA, 12 bp, Artificial Sequence
  synthetic [barcode part2]
agtcgcaccagt

SEQ ID NO: 45167 - DNA, 12 bp, Artificial Sequence
  synthetic [barcode part2]
cgaatgtgccac

SEQ ID NO: 45168 - DNA, 12 bp, Artificial Sequence
  synthetic [barcode part2]
aataatcgcgtc

SEQ ID NO: 45169 - DNA, 12 bp, Artificial Sequence
  synthetic [barcode part2]
acgcggttcaac

SEQ ID NO: 45170 - DNA, 12 bp, Artificial Sequence
  synthetic [barcode part2]
tgatgcgactat

SEQ ID NO: 45171 - DNA, 12 bp, Artificial Sequence
  synthetic [barcode part2]
tgataaccgtgt

SEQ ID NO: 45172 - DNA, 12 bp, Artificial Sequence
  synthetic [barcode part2]
cgttgtatctcg

SEQ ID NO: 45173 - DNA, 12 bp, Artificial Sequence
  synthetic [barcode part2]
ttccgactgatc

SEQ ID NO: 45174 - DNA, 12 bp, Artificial Sequence
  synthetic [barcode part2]
ttcgcactgtac

SEQ ID NO: 45175 - DNA, 12 bp, Artificial Sequence
  synthetic [barcode part2]
tcgtcggatacg

SEQ ID NO: 45176 - DNA, 12 bp, Artificial Sequence
  synthetic [barcode part2]
tggactatatgc

SEQ ID NO: 45177 - DNA, 12 bp, Artificial Sequence
  synthetic [barcode part2]
ccaacgcaatcg

SEQ ID NO: 45178 - DNA, 12 bp, Artificial Sequence
  synthetic [barcode part2]
aacggtctgcgt

SEQ ID NO: 45179 - DNA, 12 bp, Artificial Sequence
  synthetic [barcode part2]
tggtgtaattgc

SEQ ID NO: 45180 - DNA, 12 bp, Artificial Sequence
  synthetic [barcode part2]
caaccgagaagt

SEQ ID NO: 45181 - DNA, 12 bp, Artificial Sequence
  synthetic [barcode part2]
cgatatggccac

SEQ ID NO: 45182 - DNA, 12 bp, Artificial Sequence
  synthetic [barcode part2]
cgagtatactac

SEQ ID NO: 45183 - DNA, 12 bp, Artificial Sequence
  synthetic [barcode part2]
aaccatatcggt

SEQ ID NO: 45184 - DNA, 12 bp, Artificial Sequence
  synthetic [barcode part2]
tggcgcaactac

SEQ ID NO: 45185 - DNA, 12 bp, Artificial Sequence
  synthetic [barcode part2]
caatgcgatcat

SEQ ID NO: 45186 - DNA, 12 bp, Artificial Sequence
  synthetic [barcode part2]
tcggaagtgatg

SEQ ID NO: 45187 - DNA, 12 bp, Artificial Sequence
  synthetic [barcode part2]
ttcgattccgac

SEQ ID NO: 45188 - DNA, 12 bp, Artificial Sequence
  synthetic [barcode part2]
agtggtctgtat

SEQ ID NO: 45189 - DNA, 12 bp, Artificial Sequence
  synthetic [barcode part2]
cgataacatgtc

SEQ ID NO: 45190 - DNA, 12 bp, Artificial Sequence
  synthetic [barcode part2]
tattagtggtcg

SEQ ID NO: 45191 - DNA, 12 bp, Artificial Sequence
  synthetic [barcode part2]
tattcaacggtg

SEQ ID NO: 45192 - DNA, 12 bp, Artificial Sequence
  synthetic [barcode part2]
agagtcgcaatg

SEQ ID NO: 45193 - DNA, 12 bp, Artificial Sequence
  synthetic [barcode part2]
tggcgcatgatc

SEQ ID NO: 45194 - DNA, 12 bp, Artificial Sequence
  synthetic [barcode part2]
tgagagactggt

SEQ ID NO: 45195 - DNA, 12 bp, Artificial Sequence
  synthetic [barcode part2]
tgatgcggtcgt

SEQ ID NO: 45196 - DNA, 12 bp, Artificial Sequence
  synthetic [barcode part2]
tcgcgtgaactg

SEQ ID NO: 45197 - DNA, 12 bp, Artificial Sequence
  synthetic [barcode part2]
accattgatgtg

SEQ ID NO: 45198 - DNA, 12 bp, Artificial Sequence
  synthetic [barcode part2]
attataccggtg

SEQ ID NO: 45199 - DNA, 12 bp, Artificial Sequence
  synthetic [barcode part2]
acgaatccggtc

SEQ ID NO: 45200 - DNA, 12 bp, Artificial Sequence
  synthetic [barcode part2]
accatcaatacg

SEQ ID NO: 45201 - DNA, 12 bp, Artificial Sequence
  synthetic [barcode part2]
tgacaatcacgt

SEQ ID NO: 45202 - DNA, 12 bp, Artificial Sequence
  synthetic [barcode part2]
aatggtccgcac

SEQ ID NO: 45203 - DNA, 12 bp, Artificial Sequence
  synthetic [barcode part2]
tggattgcacgc

SEQ ID NO: 45204 - DNA, 12 bp, Artificial Sequence
  synthetic [barcode part2]
acatgatggtct

SEQ ID NO: 45205 - DNA, 12 bp, Artificial Sequence
  synthetic [barcode part2]
tagagagtcggt

SEQ ID NO: 45206 - DNA, 12 bp, Artificial Sequence
  synthetic [barcode part2]
aatgaagaccgc

SEQ ID NO: 45207 - DNA, 12 bp, Artificial Sequence
  synthetic [barcode part2]
taatgatgcgtc

SEQ ID NO: 45208 - DNA, 12 bp, Artificial Sequence
  synthetic [barcode part2]
accatgtcggtg

SEQ ID NO: 45209 - DNA, 12 bp, Artificial Sequence
  synthetic [barcode part2]
tcgtctctaacg

SEQ ID NO: 45210 - DNA, 12 bp, Artificial Sequence
  synthetic [barcode part2]
accagttctctg

SEQ ID NO: 45211 - DNA, 12 bp, Artificial Sequence
  synthetic [barcode part2]
taacaatcgcac

SEQ ID NO: 45212 - DNA, 12 bp, Artificial Sequence
  synthetic [barcode part2]
accattggcacg

SEQ ID NO: 45213 - DNA, 12 bp, Artificial Sequence
  synthetic [barcode part2]
tgcgttaagttg

SEQ ID NO: 45214 - DNA, 12 bp, Artificial Sequence
  synthetic [barcode part2]
taatatgaccgc

SEQ ID NO: 45215 - DNA, 12 bp, Artificial Sequence
  synthetic [barcode part2]
tggatgtgtcgc

SEQ ID NO: 45216 - DNA, 12 bp, Artificial Sequence
  synthetic [barcode part2]
cacgtcgaatcg

SEQ ID NO: 45217 - DNA, 12 bp, Artificial Sequence
  synthetic [barcode part2]
taagtcgtacac

SEQ ID NO: 45218 - DNA, 12 bp, Artificial Sequence
  synthetic [barcode part2]
aaccgtgccagt

SEQ ID NO: 45219 - DNA, 12 bp, Artificial Sequence
  synthetic [barcode part2]
tgacggtcgtgt

SEQ ID NO: 45220 - DNA, 12 bp, Artificial Sequence
  synthetic [barcode part2]
tctccagttgac

SEQ ID NO: 45221 - DNA, 12 bp, Artificial Sequence
  synthetic [barcode part2]
tgactctccagt

SEQ ID NO: 45222 - DNA, 12 bp, Artificial Sequence
  synthetic [barcode part2]
aactgcgtcggt

SEQ ID NO: 45223 - DNA, 12 bp, Artificial Sequence
  synthetic [barcode part2]
cagaatcgagac

SEQ ID NO: 45224 - DNA, 12 bp, Artificial Sequence
  synthetic [barcode part2]
tcggcgtaactg

SEQ ID NO: 45225 - DNA, 12 bp, Artificial Sequence
  synthetic [barcode part2]
ttacatagaccg

SEQ ID NO: 45226 - DNA, 12 bp, Artificial Sequence
  synthetic [barcode part2]
cggtgattacat

SEQ ID NO: 45227 - DNA, 12 bp, Artificial Sequence
  synthetic [barcode part2]
tctgcgttgtac

SEQ ID NO: 45228 - DNA, 12 bp, Artificial Sequence
  synthetic [barcode part2]
taacgaccacgc

SEQ ID NO: 45229 - DNA, 12 bp, Artificial Sequence
  synthetic [barcode part2]
agtccgatacat

SEQ ID NO: 45230 - DNA, 12 bp, Artificial Sequence
  synthetic [barcode part2]
agtagttcgtgt

SEQ ID NO: 45231 - DNA, 12 bp, Artificial Sequence
  synthetic [barcode part2]
cgaactatgtac

SEQ ID NO: 45232 - DNA, 12 bp, Artificial Sequence
  synthetic [barcode part2]
aataactcgcac

SEQ ID NO: 45233 - DNA, 12 bp, Artificial Sequence
  synthetic [barcode part2]
ccacaatcttcg

SEQ ID NO: 45234 - DNA, 12 bp, Artificial Sequence
  synthetic [barcode part2]
tcggtatagttg

SEQ ID NO: 45235 - DNA, 12 bp, Artificial Sequence
  synthetic [barcode part2]
cgacatacaatc

SEQ ID NO: 45236 - DNA, 12 bp, Artificial Sequence
  synthetic [barcode part2]
tagacataccgt

SEQ ID NO: 45237 - DNA, 12 bp, Artificial Sequence
  synthetic [barcode part2]
agtaccgtctct

SEQ ID NO: 45238 - DNA, 12 bp, Artificial Sequence
  synthetic [barcode part2]
tggacattagtc

SEQ ID NO: 45239 - DNA, 12 bp, Artificial Sequence
  synthetic [barcode part2]
aacacatggtct

SEQ ID NO: 45240 - DNA, 12 bp, Artificial Sequence
  synthetic [barcode part2]
tcgatacggtcg

SEQ ID NO: 45241 - DNA, 12 bp, Artificial Sequence
  synthetic [barcode part2]
tggtctctcaac

SEQ ID NO: 45242 - DNA, 12 bp, Artificial Sequence
  synthetic [barcode part2]
tgcaacttaacg

SEQ ID NO: 45243 - DNA, 12 bp, Artificial Sequence
  synthetic [barcode part2]
cgagagactaac

SEQ ID NO: 45244 - DNA, 12 bp, Artificial Sequence
  synthetic [barcode part2]
ccagaccatgtg

SEQ ID NO: 45245 - DNA, 12 bp, Artificial Sequence
  synthetic [barcode part2]
tatcgacggtcg

SEQ ID NO: 45246 - DNA, 12 bp, Artificial Sequence
  synthetic [barcode part2]
agaattgcgacg

SEQ ID NO: 45247 - DNA, 12 bp, Artificial Sequence
  synthetic [barcode part2]
acgaatcgccac

SEQ ID NO: 45248 - DNA, 12 bp, Artificial Sequence
  synthetic [barcode part2]
ttagtgcgaccg

SEQ ID NO: 45249 - DNA, 12 bp, Artificial Sequence
  synthetic [barcode part2]
tagtgatcacgt

SEQ ID NO: 45250 - DNA, 12 bp, Artificial Sequence
  synthetic [barcode part2]
atggcacgagat

SEQ ID NO: 45251 - DNA, 12 bp, Artificial Sequence
  synthetic [barcode part2]
tctgtatcgtgc

SEQ ID NO: 45252 - DNA, 12 bp, Artificial Sequence
  synthetic [barcode part2]
ttccgcagtatc

SEQ ID NO: 45253 - DNA, 12 bp, Artificial Sequence
  synthetic [barcode part2]
aactgtactggt

SEQ ID NO: 45254 - DNA, 12 bp, Artificial Sequence
  synthetic [barcode part2]
tggcaatcgtgc

SEQ ID NO: 45255 - DNA, 12 bp, Artificial Sequence
  synthetic [barcode part2]
tattgatgaccg

SEQ ID NO: 45256 - DNA, 12 bp, Artificial Sequence
  synthetic [barcode part2]
cgagtgcgttac

SEQ ID NO: 45257 - DNA, 12 bp, Artificial Sequence
  synthetic [barcode part2]
attccgacttcg

SEQ ID NO: 45258 - DNA, 12 bp, Artificial Sequence
  synthetic [barcode part2]
cacgtatcttcg

SEQ ID NO: 45259 - DNA, 12 bp, Artificial Sequence
  synthetic [barcode part2]
ataaccgccgac

SEQ ID NO: 45260 - DNA, 12 bp, Artificial Sequence
  synthetic [barcode part2]
tcggtatgaccg

SEQ ID NO: 45261 - DNA, 12 bp, Artificial Sequence
  synthetic [barcode part2]
tctgcaccatac

SEQ ID NO: 45262 - DNA, 12 bp, Artificial Sequence
  synthetic [barcode part2]
atactggtagtc

SEQ ID NO: 45263 - DNA, 12 bp, Artificial Sequence
  synthetic [barcode part2]
cgtggtctgatg

SEQ ID NO: 45264 - DNA, 12 bp, Artificial Sequence
  synthetic [barcode part2]
tcgtgcggattg

SEQ ID NO: 45265 - DNA, 12 bp, Artificial Sequence
  synthetic [barcode part2]
atgtggcggtct

SEQ ID NO: 45266 - DNA, 12 bp, Artificial Sequence
  synthetic [barcode part2]
cgaatgtcggtc

SEQ ID NO: 45267 - DNA, 12 bp, Artificial Sequence
  synthetic [barcode part2]
tatccgatgatg

SEQ ID NO: 45268 - DNA, 12 bp, Artificial Sequence
  synthetic [barcode part2]
cgactctagttc

SEQ ID NO: 45269 - DNA, 12 bp, Artificial Sequence
  synthetic [barcode part2]
cagaccgtgtac

SEQ ID NO: 45270 - DNA, 12 bp, Artificial Sequence
  synthetic [barcode part2]
cgatgattgtac

SEQ ID NO: 45271 - DNA, 12 bp, Artificial Sequence
  synthetic [barcode part2]
cacagttcggtg

SEQ ID NO: 45272 - DNA, 12 bp, Artificial Sequence
  synthetic [barcode part2]
tctggtcaactc

SEQ ID NO: 45273 - DNA, 12 bp, Artificial Sequence
  synthetic [barcode part2]
tcggagacaatg

SEQ ID NO: 45274 - DNA, 12 bp, Artificial Sequence
  synthetic [barcode part2]
cgaatactagtc

SEQ ID NO: 45275 - DNA, 12 bp, Artificial Sequence
  synthetic [barcode part2]
caataaccacgt

SEQ ID NO: 45276 - DNA, 12 bp, Artificial Sequence
  synthetic [barcode part2]
aatgcactcggc

SEQ ID NO: 45277 - DNA, 12 bp, Artificial Sequence
  synthetic [barcode part2]
ttcgtcgtagtc

SEQ ID NO: 45278 - DNA, 12 bp, Artificial Sequence
  synthetic [barcode part2]
accactagtatg

SEQ ID NO: 45279 - DNA, 12 bp, Artificial Sequence
  synthetic [barcode part2]
cgacaattgcgc

SEQ ID NO: 45280 - DNA, 12 bp, Artificial Sequence
  synthetic [barcode part2]
tatgagaacgcg

SEQ ID NO: 45281 - DNA, 12 bp, Artificial Sequence
  synthetic [barcode part2]
tgccgacaatcg

SEQ ID NO: 45282 - DNA, 12 bp, Artificial Sequence
  synthetic [barcode part2]
cagtaaccgtgc

SEQ ID NO: 45283 - DNA, 12 bp, Artificial Sequence
  synthetic [barcode part2]
acaaccgaatct

SEQ ID NO: 45284 - DNA, 12 bp, Artificial Sequence
  synthetic [barcode part2]
agtgaccatact

SEQ ID NO: 45285 - DNA, 12 bp, Artificial Sequence
  synthetic [barcode part2]
aaccgcaccgat

SEQ ID NO: 45286 - DNA, 12 bp, Artificial Sequence
  synthetic [barcode part2]
agagaccaactg

SEQ ID NO: 45287 - DNA, 12 bp, Artificial Sequence
  synthetic [barcode part2]
tccgagacttct

SEQ ID NO: 45288 - DNA, 12 bp, Artificial Sequence
  synthetic [barcode part2]
ttcaactctggc

SEQ ID NO: 45289 - DNA, 12 bp, Artificial Sequence
  synthetic [barcode part2]
caactctctggt

SEQ ID NO: 45290 - DNA, 12 bp, Artificial Sequence
  synthetic [barcode part2]
agtggtccacgt

SEQ ID NO: 45291 - DNA, 12 bp, Artificial Sequence
  synthetic [barcode part2]
acactaagtcgt

SEQ ID NO: 45292 - DNA, 12 bp, Artificial Sequence
  synthetic [barcode part2]
tatactagaccg

SEQ ID NO: 45293 - DNA, 12 bp, Artificial Sequence
  synthetic [barcode part2]
tcgatcacttcg

SEQ ID NO: 45294 - DNA, 12 bp, Artificial Sequence
  synthetic [barcode part2]
atattagaccgc

SEQ ID NO: 45295 - DNA, 12 bp, Artificial Sequence
  synthetic [barcode part2]
cagtagtcgcac

SEQ ID NO: 45296 - DNA, 12 bp, Artificial Sequence
  synthetic [barcode part2]
aactatgccgat

SEQ ID NO: 45297 - DNA, 12 bp, Artificial Sequence
  synthetic [barcode part2]
caccggtagttg

SEQ ID NO: 45298 - DNA, 12 bp, Artificial Sequence
  synthetic [barcode part2]
tctccgaagttc

SEQ ID NO: 45299 - DNA, 12 bp, Artificial Sequence
  synthetic [barcode part2]
tcgatgtaatcg

SEQ ID NO: 45300 - DNA, 12 bp, Artificial Sequence
  synthetic [barcode part2]
atactaacggtc

SEQ ID NO: 45301 - DNA, 12 bp, Artificial Sequence
  synthetic [barcode part2]
cggtagttgtat

SEQ ID NO: 45302 - DNA, 12 bp, Artificial Sequence
  synthetic [barcode part2]
tgcatgtctctg

SEQ ID NO: 45303 - DNA, 12 bp, Artificial Sequence
  synthetic [barcode part2]
tagacgcactat

SEQ ID NO: 45304 - DNA, 12 bp, Artificial Sequence
  synthetic [barcode part2]
acgatacggaac

SEQ ID NO: 45305 - DNA, 12 bp, Artificial Sequence
  synthetic [barcode part2]
tggatgttgatc

SEQ ID NO: 45306 - DNA, 12 bp, Artificial Sequence
  synthetic [barcode part2]
cactcggcaatg

SEQ ID NO: 45307 - DNA, 12 bp, Artificial Sequence
  synthetic [barcode part2]
aacacattcggt

SEQ ID NO: 45308 - DNA, 12 bp, Artificial Sequence
  synthetic [barcode part2]
tggcggtgtatc

SEQ ID NO: 45309 - DNA, 12 bp, Artificial Sequence
  synthetic [barcode part2]
tggcaatgcgtc

SEQ ID NO: 45310 - DNA, 12 bp, Artificial Sequence
  synthetic [barcode part2]
acacaatctggt

SEQ ID NO: 45311 - DNA, 12 bp, Artificial Sequence
  synthetic [barcode part2]
cactgtacttcg

SEQ ID NO: 45312 - DNA, 12 bp, Artificial Sequence
  synthetic [barcode part2]
tagtgtagtcgt

SEQ ID NO: 45313 - DNA, 12 bp, Artificial Sequence
  synthetic [barcode part2]
atagtgcgagac

SEQ ID NO: 45314 - DNA, 12 bp, Artificial Sequence
  synthetic [barcode part2]
cgacaatacatc

SEQ ID NO: 45315 - DNA, 12 bp, Artificial Sequence
  synthetic [barcode part2]
cgataactatgc

SEQ ID NO: 45316 - DNA, 12 bp, Artificial Sequence
  synthetic [barcode part2]
cggtaaccatat

SEQ ID NO: 45317 - DNA, 12 bp, Artificial Sequence
  synthetic [barcode part2]
aatggtcatgtc

SEQ ID NO: 45318 - DNA, 12 bp, Artificial Sequence
  synthetic [barcode part2]
tccagttggtct

SEQ ID NO: 45319 - DNA, 12 bp, Artificial Sequence
  synthetic [barcode part2]
cgttagtgaccg

SEQ ID NO: 45320 - DNA, 12 bp, Artificial Sequence
  synthetic [barcode part2]
aagattgcggtg

SEQ ID NO: 45321 - DNA, 12 bp, Artificial Sequence
  synthetic [barcode part2]
aatgagagtcgc

SEQ ID NO: 45322 - DNA, 12 bp, Artificial Sequence
  synthetic [barcode part2]
tggacatatcac

SEQ ID NO: 45323 - DNA, 12 bp, Artificial Sequence
  synthetic [barcode part2]
caccaatggtcg

SEQ ID NO: 45324 - DNA, 12 bp, Artificial Sequence
  synthetic [barcode part2]
tatagagacgcg

SEQ ID NO: 45325 - DNA, 12 bp, Artificial Sequence
  synthetic [barcode part2]
acgccgatgatc

SEQ ID NO: 45326 - DNA, 12 bp, Artificial Sequence
  synthetic [barcode part2]
cgatgcggttac

SEQ ID NO: 45327 - DNA, 12 bp, Artificial Sequence
  synthetic [barcode part2]
tagtggccatat

SEQ ID NO: 45328 - DNA, 12 bp, Artificial Sequence
  synthetic [barcode part2]
attatgtcgacg

SEQ ID NO: 45329 - DNA, 12 bp, Artificial Sequence
  synthetic [barcode part2]
tctaacttcggc

SEQ ID NO: 45330 - DNA, 12 bp, Artificial Sequence
  synthetic [barcode part2]
tctgtgcatgtc

SEQ ID NO: 45331 - DNA, 12 bp, Artificial Sequence
  synthetic [barcode part2]
aaccacgtcaat

SEQ ID NO: 45332 - DNA, 12 bp, Artificial Sequence
  synthetic [barcode part2]
cgatgtaactac

SEQ ID NO: 45333 - DNA, 12 bp, Artificial Sequence
  synthetic [barcode part2]
aactctcgtcgt

SEQ ID NO: 45334 - DNA, 12 bp, Artificial Sequence
  synthetic [barcode part2]
tgaatacgccat

SEQ ID NO: 45335 - DNA, 12 bp, Artificial Sequence
  synthetic [barcode part2]
atacaatccgac

SEQ ID NO: 45336 - DNA, 12 bp, Artificial Sequence
  synthetic [barcode part2]
tagtagtcgtgt

SEQ ID NO: 45337 - DNA, 12 bp, Artificial Sequence
  synthetic [barcode part2]
aatctggtacac

SEQ ID NO: 45338 - DNA, 12 bp, Artificial Sequence
  synthetic [barcode part2]
agagaagtctcg

SEQ ID NO: 45339 - DNA, 12 bp, Artificial Sequence
  synthetic [barcode part2]
aagaccgcaatg

SEQ ID NO: 45340 - DNA, 12 bp, Artificial Sequence
  synthetic [barcode part2]
tctactacggtc

SEQ ID NO: 45341 - DNA, 12 bp, Artificial Sequence
  synthetic [barcode part2]
tccaactccgat

SEQ ID NO: 45342 - DNA, 12 bp, Artificial Sequence
  synthetic [barcode part2]
tgactggagagt

SEQ ID NO: 45343 - DNA, 12 bp, Artificial Sequence
  synthetic [barcode part2]
taacgcaaccgc

SEQ ID NO: 45344 - DNA, 12 bp, Artificial Sequence
  synthetic [barcode part2]
tagacgcgtcgt

SEQ ID NO: 45345 - DNA, 12 bp, Artificial Sequence
  synthetic [barcode part2]
cgaattgtatgc

SEQ ID NO: 45346 - DNA, 12 bp, Artificial Sequence
  synthetic [barcode part2]
acgtcggtagtc

SEQ ID NO: 45347 - DNA, 12 bp, Artificial Sequence
  synthetic [barcode part2]
tcgagttacgcg

SEQ ID NO: 45348 - DNA, 12 bp, Artificial Sequence
  synthetic [barcode part2]
tccattgcgact

SEQ ID NO: 45349 - DNA, 12 bp, Artificial Sequence
  synthetic [barcode part2]
attcgtgcggtg

SEQ ID NO: 45350 - DNA, 12 bp, Artificial Sequence
  synthetic [barcode part2]
tcgtgtaagttg

SEQ ID NO: 45351 - DNA, 12 bp, Artificial Sequence
  synthetic [barcode part2]
aactcggcatat

SEQ ID NO: 45352 - DNA, 12 bp, Artificial Sequence
  synthetic [barcode part2]
cgagtatgtcgc

SEQ ID NO: 45353 - DNA, 12 bp, Artificial Sequence
  synthetic [barcode part2]
tggactaatgtc

SEQ ID NO: 45354 - DNA, 12 bp, Artificial Sequence
  synthetic [barcode part2]
aattcggcgcac

SEQ ID NO: 45355 - DNA, 12 bp, Artificial Sequence
  synthetic [barcode part2]
cacggtccaatg

SEQ ID NO: 45356 - DNA, 12 bp, Artificial Sequence
  synthetic [barcode part2]
agtcggtgagat

SEQ ID NO: 45357 - DNA, 12 bp, Artificial Sequence
  synthetic [barcode part2]
taacatacggtc

SEQ ID NO: 45358 - DNA, 12 bp, Artificial Sequence
  synthetic [barcode part2]
ttcatgtcacgc

SEQ ID NO: 45359 - DNA, 12 bp, Artificial Sequence
  synthetic [barcode part2]
acgtagttcggc

SEQ ID NO: 45360 - DNA, 12 bp, Artificial Sequence
  synthetic [barcode part2]
tgaactatgcgt

SEQ ID NO: 45361 - DNA, 12 bp, Artificial Sequence
  synthetic [barcode part2]
atatcggattgc

SEQ ID NO: 45362 - DNA, 12 bp, Artificial Sequence
  synthetic [barcode part2]
tggagagttgac

SEQ ID NO: 45363 - DNA, 12 bp, Artificial Sequence
  synthetic [barcode part2]
tgcatgttctcg

SEQ ID NO: 45364 - DNA, 12 bp, Artificial Sequence
  synthetic [barcode part2]
ttatctccgacg

SEQ ID NO: 45365 - DNA, 12 bp, Artificial Sequence
  synthetic [barcode part2]
acacgacttagt

SEQ ID NO: 45366 - DNA, 12 bp, Artificial Sequence
  synthetic [barcode part2]
aacgaccgcact

SEQ ID NO: 45367 - DNA, 12 bp, Artificial Sequence
  synthetic [barcode part2]
tggcataatcac

SEQ ID NO: 45368 - DNA, 12 bp, Artificial Sequence
  synthetic [barcode part2]
cacattggaccg

SEQ ID NO: 45369 - DNA, 12 bp, Artificial Sequence
  synthetic [barcode part2]
tcgacatgattg

SEQ ID NO: 45370 - DNA, 12 bp, Artificial Sequence
  synthetic [barcode part2]
caatgatcgcat

SEQ ID NO: 45371 - DNA, 12 bp, Artificial Sequence
  synthetic [barcode part2]
tgacgtggccat

SEQ ID NO: 45372 - DNA, 12 bp, Artificial Sequence
  synthetic [barcode part2]
tgagtgcgtcgt

SEQ ID NO: 45373 - DNA, 12 bp, Artificial Sequence
  synthetic [barcode part2]
tatgtcggaccg

SEQ ID NO: 45374 - DNA, 12 bp, Artificial Sequence
  synthetic [barcode part2]
tggtgcgatcac

SEQ ID NO: 45375 - DNA, 12 bp, Artificial Sequence
  synthetic [barcode part2]
tggcggttgtac

SEQ ID NO: 45376 - DNA, 12 bp, Artificial Sequence
  synthetic [barcode part2]
agtacgcggtct

SEQ ID NO: 45377 - DNA, 12 bp, Artificial Sequence
  synthetic [barcode part2]
cgatatgcggtc

SEQ ID NO: 45378 - DNA, 12 bp, Artificial Sequence
  synthetic [barcode part2]
ttcacgcatgtc

SEQ ID NO: 45379 - DNA, 12 bp, Artificial Sequence
  synthetic [barcode part2]
tccgtcggttat

SEQ ID NO: 45380 - DNA, 12 bp, Artificial Sequence
  synthetic [barcode part2]
caacatacgact

SEQ ID NO: 45381 - DNA, 12 bp, Artificial Sequence
  synthetic [barcode part2]
cgaagttctctc

SEQ ID NO: 45382 - DNA, 12 bp, Artificial Sequence
  synthetic [barcode part2]
tgaatgtcgact

SEQ ID NO: 45383 - DNA, 12 bp, Artificial Sequence
  synthetic [barcode part2]
cggaccgtatgt

SEQ ID NO: 45384 - DNA, 12 bp, Artificial Sequence
  synthetic [barcode part2]
tcgttagacgcg

SEQ ID NO: 45385 - DNA, 12 bp, Artificial Sequence
  synthetic [barcode part2]
caaccagagagt

SEQ ID NO: 45386 - DNA, 12 bp, Artificial Sequence
  synthetic [barcode part2]
ttatgcgagttg

SEQ ID NO: 45387 - DNA, 12 bp, Artificial Sequence
  synthetic [barcode part2]
accgttagtgcg

SEQ ID NO: 45388 - DNA, 12 bp, Artificial Sequence
  synthetic [barcode part2]
tataactcgacg

SEQ ID NO: 45389 - DNA, 12 bp, Artificial Sequence
  synthetic [barcode part2]
atggtcgtcaat

SEQ ID NO: 45390 - DNA, 12 bp, Artificial Sequence
  synthetic [barcode part2]
tccgcgttacat

SEQ ID NO: 45391 - DNA, 12 bp, Artificial Sequence
  synthetic [barcode part2]
tggtacacaatc

SEQ ID NO: 45392 - DNA, 12 bp, Artificial Sequence
  synthetic [barcode part2]
ttctcaatcggc

SEQ ID NO: 45393 - DNA, 12 bp, Artificial Sequence
  synthetic [barcode part2]
tcggaccgtatg

SEQ ID NO: 45394 - DNA, 12 bp, Artificial Sequence
  synthetic [barcode part2]
ccaatacgattg

SEQ ID NO: 45395 - DNA, 12 bp, Artificial Sequence
  synthetic [barcode part2]
tagattggcact

SEQ ID NO: 45396 - DNA, 12 bp, Artificial Sequence
  synthetic [barcode part2]
ttaccagacgcg

SEQ ID NO: 45397 - DNA, 12 bp, Artificial Sequence
  synthetic [barcode part2]
cagacatgtcgc

SEQ ID NO: 45398 - DNA, 12 bp, Artificial Sequence
  synthetic [barcode part2]
taactcttcggc

SEQ ID NO: 45399 - DNA, 12 bp, Artificial Sequence
  synthetic [barcode part2]
tggatacgttac

SEQ ID NO: 45400 - DNA, 12 bp, Artificial Sequence
  synthetic [barcode part2]
tctcgaccaatc

SEQ ID NO: 45401 - DNA, 12 bp, Artificial Sequence
  synthetic [barcode part2]
cgaacatgttac

SEQ ID NO: 45402 - DNA, 12 bp, Artificial Sequence
  synthetic [barcode part2]
caacaatcgtgt

SEQ ID NO: 45403 - DNA, 12 bp, Artificial Sequence
  synthetic [barcode part2]
caacttcggtct

SEQ ID NO: 45404 - DNA, 12 bp, Artificial Sequence
  synthetic [barcode part2]
acggattaccgc

SEQ ID NO: 45405 - DNA, 12 bp, Artificial Sequence
  synthetic [barcode part2]
tagtgcggttat

SEQ ID NO: 45406 - DNA, 12 bp, Artificial Sequence
  synthetic [barcode part2]
ttaatgtggtcg

SEQ ID NO: 45407 - DNA, 12 bp, Artificial Sequence
  synthetic [barcode part2]
tgatgtaaccgt

SEQ ID NO: 45408 - DNA, 12 bp, Artificial Sequence
  synthetic [barcode part2]
cgaagttggaac

SEQ ID NO: 45409 - DNA, 12 bp, Artificial Sequence
  synthetic [barcode part2]
caagtcggcact

SEQ ID NO: 45410 - DNA, 12 bp, Artificial Sequence
  synthetic [barcode part2]
tggtatgtgatc

SEQ ID NO: 45411 - DNA, 12 bp, Artificial Sequence
  synthetic [barcode part2]
acgagagtgtac

SEQ ID NO: 45412 - DNA, 12 bp, Artificial Sequence
  synthetic [barcode part2]
tgagtcgcatat

SEQ ID NO: 45413 - DNA, 12 bp, Artificial Sequence
  synthetic [barcode part2]
atgcgacttgat

SEQ ID NO: 45414 - DNA, 12 bp, Artificial Sequence
  synthetic [barcode part2]
ttaacgcgattg

SEQ ID NO: 45415 - DNA, 12 bp, Artificial Sequence
  synthetic [barcode part2]
tctattggtcgc

SEQ ID NO: 45416 - DNA, 12 bp, Artificial Sequence
  synthetic [barcode part2]
cagtctcgattc

SEQ ID NO: 45417 - DNA, 12 bp, Artificial Sequence
  synthetic [barcode part2]
tggatcaacatc

SEQ ID NO: 45418 - DNA, 12 bp, Artificial Sequence
  synthetic [barcode part2]
aacggaagtcgt

SEQ ID NO: 45419 - DNA, 12 bp, Artificial Sequence
  synthetic [barcode part2]
acaatcaccgat

SEQ ID NO: 45420 - DNA, 12 bp, Artificial Sequence
  synthetic [barcode part2]
atgtcaagtcgt

SEQ ID NO: 45421 - DNA, 12 bp, Artificial Sequence
  synthetic [barcode part2]
tcgaactatacg

SEQ ID NO: 45422 - DNA, 12 bp, Artificial Sequence
  synthetic [barcode part2]
atggaccattgt

SEQ ID NO: 45423 - DNA, 12 bp, Artificial Sequence
  synthetic [barcode part2]
aatcataccgac

SEQ ID NO: 45424 - DNA, 12 bp, Artificial Sequence
  synthetic [barcode part2]
cgacataaccgc

SEQ ID NO: 45425 - DNA, 12 bp, Artificial Sequence
  synthetic [barcode part2]
attcgacgcacg

SEQ ID NO: 45426 - DNA, 12 bp, Artificial Sequence
  synthetic [barcode part2]
taatggccgcac

SEQ ID NO: 45427 - DNA, 12 bp, Artificial Sequence
  synthetic [barcode part2]
acatcggactat

SEQ ID NO: 45428 - DNA, 12 bp, Artificial Sequence
  synthetic [barcode part2]
taagtgcgccac

SEQ ID NO: 45429 - DNA, 12 bp, Artificial Sequence
  synthetic [barcode part2]
tgatgattgcgt

SEQ ID NO: 45430 - DNA, 12 bp, Artificial Sequence
  synthetic [barcode part2]
tcttgcgtatgc

SEQ ID NO: 45431 - DNA, 12 bp, Artificial Sequence
  synthetic [barcode part2]
tgagtgcactat

SEQ ID NO: 45432 - DNA, 12 bp, Artificial Sequence
  synthetic [barcode part2]
tggtaaccacgc

SEQ ID NO: 45433 - DNA, 12 bp, Artificial Sequence
  synthetic [barcode part2]
tggttgagagac

SEQ ID NO: 45434 - DNA, 12 bp, Artificial Sequence
  synthetic [barcode part2]
cgacgcaattgc

SEQ ID NO: 45435 - DNA, 12 bp, Artificial Sequence
  synthetic [barcode part2]
taatgcgcggtc

SEQ ID NO: 45436 - DNA, 12 bp, Artificial Sequence
  synthetic [barcode part2]
cgataaccgcac

SEQ ID NO: 45437 - DNA, 12 bp, Artificial Sequence
  synthetic [barcode part2]
cgagttaacatc

SEQ ID NO: 45438 - DNA, 12 bp, Artificial Sequence
  synthetic [barcode part2]
ttcattgaccgc

SEQ ID NO: 45439 - DNA, 12 bp, Artificial Sequence
  synthetic [barcode part2]
tcttagtaccgc

SEQ ID NO: 45440 - DNA, 12 bp, Artificial Sequence
  synthetic [barcode part2]
ttaacatgaccg

SEQ ID NO: 45441 - DNA, 12 bp, Artificial Sequence
  synthetic [barcode part2]
ttcacatcgtgc

SEQ ID NO: 45442 - DNA, 12 bp, Artificial Sequence
  synthetic [barcode part2]
tggtaacgtatc

SEQ ID NO: 45443 - DNA, 12 bp, Artificial Sequence
  synthetic [barcode part2]
tctgcacacatc

SEQ ID NO: 45444 - DNA, 12 bp, Artificial Sequence
  synthetic [barcode part2]
tgccatattccg

SEQ ID NO: 45445 - DNA, 12 bp, Artificial Sequence
  synthetic [barcode part2]
tggtagtcatac

SEQ ID NO: 45446 - DNA, 12 bp, Artificial Sequence
  synthetic [barcode part2]
agttcggcacgt

SEQ ID NO: 45447 - DNA, 12 bp, Artificial Sequence
  synthetic [barcode part2]
agataaccgacg

SEQ ID NO: 45448 - DNA, 12 bp, Artificial Sequence
  synthetic [barcode part2]
tgagttacacgt

SEQ ID NO: 45449 - DNA, 12 bp, Artificial Sequence
  synthetic [barcode part2]
tataccggattg

SEQ ID NO: 45450 - DNA, 12 bp, Artificial Sequence
  synthetic [barcode part2]
tctctggtcaac

SEQ ID NO: 45451 - DNA, 12 bp, Artificial Sequence
  synthetic [barcode part2]
atgcaattcggt

SEQ ID NO: 45452 - DNA, 12 bp, Artificial Sequence
  synthetic [barcode part2]
tccggaagaagt

SEQ ID NO: 45453 - DNA, 12 bp, Artificial Sequence
  synthetic [barcode part2]
atggtgcggaat

SEQ ID NO: 45454 - DNA, 12 bp, Artificial Sequence
  synthetic [barcode part2]
tatgcgttctcg

SEQ ID NO: 45455 - DNA, 12 bp, Artificial Sequence
  synthetic [barcode part2]
ttcgccacaatc

SEQ ID NO: 45456 - DNA, 12 bp, Artificial Sequence
  synthetic [barcode part2]
tcgccgagtatg

SEQ ID NO: 45457 - DNA, 12 bp, Artificial Sequence
  synthetic [barcode part2]
aatgtcggagac

SEQ ID NO: 45458 - DNA, 12 bp, Artificial Sequence
  synthetic [barcode part2]
tccgaagtctct

SEQ ID NO: 45459 - DNA, 12 bp, Artificial Sequence
  synthetic [barcode part2]
taacggtacatc

SEQ ID NO: 45460 - DNA, 12 bp, Artificial Sequence
  synthetic [barcode part2]
attgtcggtgcg

SEQ ID NO: 45461 - DNA, 12 bp, Artificial Sequence
  synthetic [barcode part2]
ccaccgaatgtg

SEQ ID NO: 45462 - DNA, 12 bp, Artificial Sequence
  synthetic [barcode part2]
tcgcacgagttg

SEQ ID NO: 45463 - DNA, 12 bp, Artificial Sequence
  synthetic [barcode part2]
tggtacaaccgc

SEQ ID NO: 45464 - DNA, 12 bp, Artificial Sequence
  synthetic [barcode part2]
agacgactaacg

SEQ ID NO: 45465 - DNA, 12 bp, Artificial Sequence
  synthetic [barcode part2]
acgtggcgattc

SEQ ID NO: 45466 - DNA, 12 bp, Artificial Sequence
  synthetic [barcode part2]
tccgcactatgt

SEQ ID NO: 45467 - DNA, 12 bp, Artificial Sequence
  synthetic [barcode part2]
cgaaccgcatac

SEQ ID NO: 45468 - DNA, 12 bp, Artificial Sequence
  synthetic [barcode part2]
caacgcagtcgt

SEQ ID NO: 45469 - DNA, 12 bp, Artificial Sequence
  synthetic [barcode part2]
agactaagaccg

SEQ ID NO: 45470 - DNA, 12 bp, Artificial Sequence
  synthetic [barcode part2]
accgcactaacg

SEQ ID NO: 45471 - DNA, 12 bp, Artificial Sequence
  synthetic [barcode part2]
taacacgtagtc

SEQ ID NO: 45472 - DNA, 12 bp, Artificial Sequence
  synthetic [barcode part2]
acaactatcggt

SEQ ID NO: 45473 - DNA, 12 bp, Artificial Sequence
  synthetic [barcode part2]
tgacgtgtaact

SEQ ID NO: 45474 - DNA, 12 bp, Artificial Sequence
  synthetic [barcode part2]
tcttcaactggc

SEQ ID NO: 45475 - DNA, 12 bp, Artificial Sequence
  synthetic [barcode part2]
attgcgtcggtg

SEQ ID NO: 45476 - DNA, 12 bp, Artificial Sequence
  synthetic [barcode part2]
cggcgactgtat

SEQ ID NO: 45477 - DNA, 12 bp, Artificial Sequence
  synthetic [barcode part2]
taacggttgcgc

SEQ ID NO: 45478 - DNA, 12 bp, Artificial Sequence
  synthetic [barcode part2]
tatccagtggcg

SEQ ID NO: 45479 - DNA, 12 bp, Artificial Sequence
  synthetic [barcode part2]
atgcaatggtct

SEQ ID NO: 45480 - DNA, 12 bp, Artificial Sequence
  synthetic [barcode part2]
accgttaacatg

SEQ ID NO: 45481 - DNA, 12 bp, Artificial Sequence
  synthetic [barcode part2]
tatcttcgcacg

SEQ ID NO: 45482 - DNA, 12 bp, Artificial Sequence
  synthetic [barcode part2]
aatcgacggaac

SEQ ID NO: 45483 - DNA, 12 bp, Artificial Sequence
  synthetic [barcode part2]
ccacacgaatcg

SEQ ID NO: 45484 - DNA, 12 bp, Artificial Sequence
  synthetic [barcode part2]
acgaactatcac

SEQ ID NO: 45485 - DNA, 12 bp, Artificial Sequence
  synthetic [barcode part2]
ttctgcgtacac

SEQ ID NO: 45486 - DNA, 12 bp, Artificial Sequence
  synthetic [barcode part2]
tagaccgtgcgt

SEQ ID NO: 45487 - DNA, 12 bp, Artificial Sequence
  synthetic [barcode part2]
acaccagtaact

SEQ ID NO: 45488 - DNA, 12 bp, Artificial Sequence
  synthetic [barcode part2]
tcgaatcgcacg

SEQ ID NO: 45489 - DNA, 12 bp, Artificial Sequence
  synthetic [barcode part2]
cgacacgtgatc

SEQ ID NO: 45490 - DNA, 12 bp, Artificial Sequence
  synthetic [barcode part2]
tatcgtgtctcg

SEQ ID NO: 45491 - DNA, 12 bp, Artificial Sequence
  synthetic [barcode part2]
agtcggtagagt

SEQ ID NO: 45492 - DNA, 12 bp, Artificial Sequence
  synthetic [barcode part2]
attccagtctcg

SEQ ID NO: 45493 - DNA, 12 bp, Artificial Sequence
  synthetic [barcode part2]
tatggtccgacg

SEQ ID NO: 45494 - DNA, 12 bp, Artificial Sequence
  synthetic [barcode part2]
tcttaacgtcgc

SEQ ID NO: 45495 - DNA, 12 bp, Artificial Sequence
  synthetic [barcode part2]
tggtgatatgtc

SEQ ID NO: 45496 - DNA, 12 bp, Artificial Sequence
  synthetic [barcode part2]
agtccgaatact

SEQ ID NO: 45497 - DNA, 12 bp, Artificial Sequence
  synthetic [barcode part2]
attctggttccg

SEQ ID NO: 45498 - DNA, 12 bp, Artificial Sequence
  synthetic [barcode part2]
agtgattcgcat

SEQ ID NO: 45499 - DNA, 12 bp, Artificial Sequence
  synthetic [barcode part2]
tggtacagttac

SEQ ID NO: 45500 - DNA, 12 bp, Artificial Sequence
  synthetic [barcode part2]
tgagtataccgt

SEQ ID NO: 45501 - DNA, 12 bp, Artificial Sequence
  synthetic [barcode part2]
cgatggcacatc

SEQ ID NO: 45502 - DNA, 12 bp, Artificial Sequence
  synthetic [barcode part2]
cgatgcgcaatc

SEQ ID NO: 45503 - DNA, 12 bp, Artificial Sequence
  synthetic [barcode part2]
ttccacgatgtc

SEQ ID NO: 45504 - DNA, 12 bp, Artificial Sequence
  synthetic [barcode part2]
ttctctcggaac

SEQ ID NO: 45505 - DNA, 12 bp, Artificial Sequence
  synthetic [barcode part2]
cgacgtgatcac

SEQ ID NO: 45506 - DNA, 12 bp, Artificial Sequence
  synthetic [barcode part2]
acgatcactaac

SEQ ID NO: 45507 - DNA, 12 bp, Artificial Sequence
  synthetic [barcode part2]
cagataccggtc

SEQ ID NO: 45508 - DNA, 12 bp, Artificial Sequence
  synthetic [barcode part2]
tgaccgacttct

SEQ ID NO: 45509 - DNA, 12 bp, Artificial Sequence
  synthetic [barcode part2]
aatccgaacatc

SEQ ID NO: 45510 - DNA, 12 bp, Artificial Sequence
  synthetic [barcode part2]
aagaatcgaccg

SEQ ID NO: 45511 - DNA, 12 bp, Artificial Sequence
  synthetic [barcode part2]
cgattccaactc

SEQ ID NO: 45512 - DNA, 12 bp, Artificial Sequence
  synthetic [barcode part2]
aatatgttcggc

SEQ ID NO: 45513 - DNA, 12 bp, Artificial Sequence
  synthetic [barcode part2]
acgccgaactac

SEQ ID NO: 45514 - DNA, 12 bp, Artificial Sequence
  synthetic [barcode part2]
tctaccgatcac

SEQ ID NO: 45515 - DNA, 12 bp, Artificial Sequence
  synthetic [barcode part2]
caacgtggttat

SEQ ID NO: 45516 - DNA, 12 bp, Artificial Sequence
  synthetic [barcode part2]
accgtattgatg

SEQ ID NO: 45517 - DNA, 12 bp, Artificial Sequence
  synthetic [barcode part2]
accgtcggtatg

SEQ ID NO: 45518 - DNA, 12 bp, Artificial Sequence
  synthetic [barcode part2]
caccgacgattg

SEQ ID NO: 45519 - DNA, 12 bp, Artificial Sequence
  synthetic [barcode part2]
accatgttaacg

SEQ ID NO: 45520 - DNA, 12 bp, Artificial Sequence
  synthetic [barcode part2]
aagtagtcgacg

SEQ ID NO: 45521 - DNA, 12 bp, Artificial Sequence
  synthetic [barcode part2]
cggtgatatact

SEQ ID NO: 45522 - DNA, 12 bp, Artificial Sequence
  synthetic [barcode part2]
ttcatcagtcgc

SEQ ID NO: 45523 - DNA, 12 bp, Artificial Sequence
  synthetic [barcode part2]
tagataccgact

SEQ ID NO: 45524 - DNA, 12 bp, Artificial Sequence
  synthetic [barcode part2]
accgcgttagtg

SEQ ID NO: 45525 - DNA, 12 bp, Artificial Sequence
  synthetic [barcode part2]
atagaccaccgc

SEQ ID NO: 45526 - DNA, 12 bp, Artificial Sequence
  synthetic [barcode part2]
cacacattctcg

SEQ ID NO: 45527 - DNA, 12 bp, Artificial Sequence
  synthetic [barcode part2]
atgtcggaccgt

SEQ ID NO: 45528 - DNA, 12 bp, Artificial Sequence
  synthetic [barcode part2]
tgcaccgagttg

SEQ ID NO: 45529 - DNA, 12 bp, Artificial Sequence
  synthetic [barcode part2]
caacggttgtat

SEQ ID NO: 45530 - DNA, 12 bp, Artificial Sequence
  synthetic [barcode part2]
tccatgtgcact

SEQ ID NO: 45531 - DNA, 12 bp, Artificial Sequence
  synthetic [barcode part2]
atgactactggt

SEQ ID NO: 45532 - DNA, 12 bp, Artificial Sequence
  synthetic [barcode part2]
ttctcggtcaac

SEQ ID NO: 45533 - DNA, 12 bp, Artificial Sequence
  synthetic [barcode part2]
agtcgacgaagt

SEQ ID NO: 45534 - DNA, 12 bp, Artificial Sequence
  synthetic [barcode part2]
cgtagttcgacg

SEQ ID NO: 45535 - DNA, 12 bp, Artificial Sequence
  synthetic [barcode part2]
tgaacatgtcgt

SEQ ID NO: 45536 - DNA, 12 bp, Artificial Sequence
  synthetic [barcode part2]
cgttcggtgatg

SEQ ID NO: 45537 - DNA, 12 bp, Artificial Sequence
  synthetic [barcode part2]
tgcgtcggattg

SEQ ID NO: 45538 - DNA, 12 bp, Artificial Sequence
  synthetic [barcode part2]
taacgtggtcgc

SEQ ID NO: 45539 - DNA, 12 bp, Artificial Sequence
  synthetic [barcode part2]
tgcaactcggtg

SEQ ID NO: 45540 - DNA, 12 bp, Artificial Sequence
  synthetic [barcode part2]
aattgcgagttc

SEQ ID NO: 45541 - DNA, 12 bp, Artificial Sequence
  synthetic [barcode part2]
tgacatagtcgt

SEQ ID NO: 45542 - DNA, 12 bp, Artificial Sequence
  synthetic [barcode part2]
tgacggtatact

SEQ ID NO: 45543 - DNA, 12 bp, Artificial Sequence
  synthetic [barcode part2]
tgagaagtcggt

SEQ ID NO: 45544 - DNA, 12 bp, Artificial Sequence
  synthetic [barcode part2]
atacgactcaac

SEQ ID NO: 45545 - DNA, 12 bp, Artificial Sequence
  synthetic [barcode part2]
ccaactatctcg

SEQ ID NO: 45546 - DNA, 12 bp, Artificial Sequence
  synthetic [barcode part2]
tgaattgcgtgt

SEQ ID NO: 45547 - DNA, 12 bp, Artificial Sequence
  synthetic [barcode part2]
cggttgagaagt

SEQ ID NO: 45548 - DNA, 12 bp, Artificial Sequence
  synthetic [barcode part2]
cgatatgattgc

SEQ ID NO: 45549 - DNA, 12 bp, Artificial Sequence
  synthetic [barcode part2]
tgacgaccgcat

SEQ ID NO: 45550 - DNA, 12 bp, Artificial Sequence
  synthetic [barcode part2]
taatagtcacgc

SEQ ID NO: 45551 - DNA, 12 bp, Artificial Sequence
  synthetic [barcode part2]
tggatcatgcgc

SEQ ID NO: 45552 - DNA, 12 bp, Artificial Sequence
  synthetic [barcode part2]
tatcggtaatcg

SEQ ID NO: 45553 - DNA, 12 bp, Artificial Sequence
  synthetic [barcode part2]
atgttgacgact

SEQ ID NO: 45554 - DNA, 12 bp, Artificial Sequence
  synthetic [barcode part2]
tcttatgtgcgc

SEQ ID NO: 45555 - DNA, 12 bp, Artificial Sequence
  synthetic [barcode part2]
ttccacgtatgc

SEQ ID NO: 45556 - DNA, 12 bp, Artificial Sequence
  synthetic [barcode part2]
cgaattgcgcac

SEQ ID NO: 45557 - DNA, 12 bp, Artificial Sequence
  synthetic [barcode part2]
agtgtatggtct

SEQ ID NO: 45558 - DNA, 12 bp, Artificial Sequence
  synthetic [barcode part2]
tctcacgtacac

SEQ ID NO: 45559 - DNA, 12 bp, Artificial Sequence
  synthetic [barcode part2]
tcgttgaacatg

SEQ ID NO: 45560 - DNA, 12 bp, Artificial Sequence
  synthetic [barcode part2]
cgacttcgattc

SEQ ID NO: 45561 - DNA, 12 bp, Artificial Sequence
  synthetic [barcode part2]
tgacacgaccgt

SEQ ID NO: 45562 - DNA, 12 bp, Artificial Sequence
  synthetic [barcode part2]
agtcgtgttagt

SEQ ID NO: 45563 - DNA, 12 bp, Artificial Sequence
  synthetic [barcode part2]
ttcgagagagac

SEQ ID NO: 45564 - DNA, 12 bp, Artificial Sequence
  synthetic [barcode part2]
aaccgacagagt

SEQ ID NO: 45565 - DNA, 12 bp, Artificial Sequence
  synthetic [barcode part2]
cgagtattgatc

SEQ ID NO: 45566 - DNA, 12 bp, Artificial Sequence
  synthetic [barcode part2]
agagagacttcg

SEQ ID NO: 45567 - DNA, 12 bp, Artificial Sequence
  synthetic [barcode part2]
aacgagacgact

SEQ ID NO: 45568 - DNA, 12 bp, Artificial Sequence
  synthetic [barcode part2]
tggtagttgcgc

SEQ ID NO: 45569 - DNA, 12 bp, Artificial Sequence
  synthetic [barcode part2]
ttacgactctcg

SEQ ID NO: 45570 - DNA, 12 bp, Artificial Sequence
  synthetic [barcode part2]
tctgaccagttc

SEQ ID NO: 45571 - DNA, 12 bp, Artificial Sequence
  synthetic [barcode part2]
caatatggtcgt

SEQ ID NO: 45572 - DNA, 12 bp, Artificial Sequence
  synthetic [barcode part2]
ccatcggacatg

SEQ ID NO: 45573 - DNA, 12 bp, Artificial Sequence
  synthetic [barcode part2]
agtcgcattgat

SEQ ID NO: 45574 - DNA, 12 bp, Artificial Sequence
  synthetic [barcode part2]
taatggcatgtc

SEQ ID NO: 45575 - DNA, 12 bp, Artificial Sequence
  synthetic [barcode part2]
tggtaactgtac

SEQ ID NO: 45576 - DNA, 12 bp, Artificial Sequence
  synthetic [barcode part2]
aattatgtcggc

SEQ ID NO: 45577 - DNA, 12 bp, Artificial Sequence
  synthetic [barcode part2]
aatcttcgccac

SEQ ID NO: 45578 - DNA, 12 bp, Artificial Sequence
  synthetic [barcode part2]
tatctctgcgtg

SEQ ID NO: 45579 - DNA, 12 bp, Artificial Sequence
  synthetic [barcode part2]
agatagtcggtg

SEQ ID NO: 45580 - DNA, 12 bp, Artificial Sequence
  synthetic [barcode part2]
agaaccgtgatg

SEQ ID NO: 45581 - DNA, 12 bp, Artificial Sequence
  synthetic [barcode part2]
tggataccaatc

SEQ ID NO: 45582 - DNA, 12 bp, Artificial Sequence
  synthetic [barcode part2]
aagtcaagaccg

SEQ ID NO: 45583 - DNA, 12 bp, Artificial Sequence
  synthetic [barcode part2]
tctgtatgcgtc

SEQ ID NO: 45584 - DNA, 12 bp, Artificial Sequence
  synthetic [barcode part2]
tggacgcattgc

SEQ ID NO: 45585 - DNA, 12 bp, Artificial Sequence
  synthetic [barcode part2]
tgcagagacatg

SEQ ID NO: 45586 - DNA, 12 bp, Artificial Sequence
  synthetic [barcode part2]
cgatctcagttc

SEQ ID NO: 45587 - DNA, 12 bp, Artificial Sequence
  synthetic [barcode part2]
accgtgccaatg

SEQ ID NO: 45588 - DNA, 12 bp, Artificial Sequence
  synthetic [barcode part2]
tagtaaccgcat

SEQ ID NO: 45589 - DNA, 12 bp, Artificial Sequence
  synthetic [barcode part2]
tctctaatcggc

SEQ ID NO: 45590 - DNA, 12 bp, Artificial Sequence
  synthetic [barcode part2]
tcggattacatg

SEQ ID NO: 45591 - DNA, 12 bp, Artificial Sequence
  synthetic [barcode part2]
tggttccgattc

SEQ ID NO: 45592 - DNA, 12 bp, Artificial Sequence
  synthetic [barcode part2]
ttacacggattg

SEQ ID NO: 45593 - DNA, 12 bp, Artificial Sequence
  synthetic [barcode part2]
agtgtattcggt

SEQ ID NO: 45594 - DNA, 12 bp, Artificial Sequence
  synthetic [barcode part2]
tctcgtggtatc

SEQ ID NO: 45595 - DNA, 12 bp, Artificial Sequence
  synthetic [barcode part2]
taaccgagagac

SEQ ID NO: 45596 - DNA, 12 bp, Artificial Sequence
  synthetic [barcode part2]
tctatgttgcgc

SEQ ID NO: 45597 - DNA, 12 bp, Artificial Sequence
  synthetic [barcode part2]
tcttcggaactc

SEQ ID NO: 45598 - DNA, 12 bp, Artificial Sequence
  synthetic [barcode part2]
aactcggtgcgt

SEQ ID NO: 45599 - DNA, 12 bp, Artificial Sequence
  synthetic [barcode part2]
atggaccgccat

SEQ ID NO: 45600 - DNA, 12 bp, Artificial Sequence
  synthetic [barcode part2]
ttcttgaccgac

SEQ ID NO: 45601 - DNA, 12 bp, Artificial Sequence
  synthetic [barcode part2]
cggtacagtcgt

SEQ ID NO: 45602 - DNA, 12 bp, Artificial Sequence
  synthetic [barcode part2]
tagtacacgact

SEQ ID NO: 45603 - DNA, 12 bp, Artificial Sequence
  synthetic [barcode part2]
tggcgtgcaatc

SEQ ID NO: 45604 - DNA, 12 bp, Artificial Sequence
  synthetic [barcode part2]
aaccgtgttgat

SEQ ID NO: 45605 - DNA, 12 bp, Artificial Sequence
  synthetic [barcode part2]
taatacagtcgc

SEQ ID NO: 45606 - DNA, 12 bp, Artificial Sequence
  synthetic [barcode part2]
acgatcatcggc

SEQ ID NO: 45607 - DNA, 12 bp, Artificial Sequence
  synthetic [barcode part2]
tataatccggtg

SEQ ID NO: 45608 - DNA, 12 bp, Artificial Sequence
  synthetic [barcode part2]
tgcattgaactg

SEQ ID NO: 45609 - DNA, 12 bp, Artificial Sequence
  synthetic [barcode part2]
accacatcaatg

SEQ ID NO: 45610 - DNA, 12 bp, Artificial Sequence
  synthetic [barcode part2]
tctgcgtgtatc

SEQ ID NO: 45611 - DNA, 12 bp, Artificial Sequence
  synthetic [barcode part2]
agaccagaatcg

SEQ ID NO: 45612 - DNA, 12 bp, Artificial Sequence
  synthetic [barcode part2]
cactgataatcg

SEQ ID NO: 45613 - DNA, 12 bp, Artificial Sequence
  synthetic [barcode part2]
acggtcgagttc

SEQ ID NO: 45614 - DNA, 12 bp, Artificial Sequence
  synthetic [barcode part2]
atggccaccgat

SEQ ID NO: 45615 - DNA, 12 bp, Artificial Sequence
  synthetic [barcode part2]
taatgcgattgc

SEQ ID NO: 45616 - DNA, 12 bp, Artificial Sequence
  synthetic [barcode part2]
tatctggcggtg

SEQ ID NO: 45617 - DNA, 12 bp, Artificial Sequence
  synthetic [barcode part2]
tgatagtgcact

SEQ ID NO: 45618 - DNA, 12 bp, Artificial Sequence
  synthetic [barcode part2]
tctcgcacatac

SEQ ID NO: 45619 - DNA, 12 bp, Artificial Sequence
  synthetic [barcode part2]
acgagttactac

SEQ ID NO: 45620 - DNA, 12 bp, Artificial Sequence
  synthetic [barcode part2]
ttcacatgcgtc

SEQ ID NO: 45621 - DNA, 12 bp, Artificial Sequence
  synthetic [barcode part2]
tcgtaactctcg

SEQ ID NO: 45622 - DNA, 12 bp, Artificial Sequence
  synthetic [barcode part2]
ttcgtatcgcac

SEQ ID NO: 45623 - DNA, 12 bp, Artificial Sequence
  synthetic [barcode part2]
atggattcgact

SEQ ID NO: 45624 - DNA, 12 bp, Artificial Sequence
  synthetic [barcode part2]
tcttgtacgtgc

SEQ ID NO: 45625 - DNA, 12 bp, Artificial Sequence
  synthetic [barcode part2]
cgatacaatcac

SEQ ID NO: 45626 - DNA, 12 bp, Artificial Sequence
  synthetic [barcode part2]
ttcaccgattgc

SEQ ID NO: 45627 - DNA, 12 bp, Artificial Sequence
  synthetic [barcode part2]
tgatatgcgact

SEQ ID NO: 45628 - DNA, 12 bp, Artificial Sequence
  synthetic [barcode part2]
aatcttccggtc

SEQ ID NO: 45629 - DNA, 12 bp, Artificial Sequence
  synthetic [barcode part2]
cggtgcgtaact

SEQ ID NO: 45630 - DNA, 12 bp, Artificial Sequence
  synthetic [barcode part2]
cacgagaatgtg

SEQ ID NO: 45631 - DNA, 12 bp, Artificial Sequence
  synthetic [barcode part2]
aaccacgaatct

SEQ ID NO: 45632 - DNA, 12 bp, Artificial Sequence
  synthetic [barcode part2]
attaccgacgcg

SEQ ID NO: 45633 - DNA, 12 bp, Artificial Sequence
  synthetic [barcode part2]
ttcgaccgattc

SEQ ID NO: 45634 - DNA, 12 bp, Artificial Sequence
  synthetic [barcode part2]
cgatgatcacgc

SEQ ID NO: 45635 - DNA, 12 bp, Artificial Sequence
  synthetic [barcode part2]
agttgtatcggt

SEQ ID NO: 45636 - DNA, 12 bp, Artificial Sequence
  synthetic [barcode part2]
tgacggttacat

SEQ ID NO: 45637 - DNA, 12 bp, Artificial Sequence
  synthetic [barcode part2]
attcgtgtaacg

SEQ ID NO: 45638 - DNA, 12 bp, Artificial Sequence
  synthetic [barcode part2]
cggtagtcacgt

SEQ ID NO: 45639 - DNA, 12 bp, Artificial Sequence
  synthetic [barcode part2]
cgaaccgacatc

SEQ ID NO: 45640 - DNA, 12 bp, Artificial Sequence
  synthetic [barcode part2]
tgacgtgattgt

SEQ ID NO: 45641 - DNA, 12 bp, Artificial Sequence
  synthetic [barcode part2]
acgaacttagtc

SEQ ID NO: 45642 - DNA, 12 bp, Artificial Sequence
  synthetic [barcode part2]
tagactacacgt

SEQ ID NO: 45643 - DNA, 12 bp, Artificial Sequence
  synthetic [barcode part2]
tatgtcgagttg

SEQ ID NO: 45644 - DNA, 12 bp, Artificial Sequence
  synthetic [barcode part2]
ataagttaccgc

SEQ ID NO: 45645 - DNA, 12 bp, Artificial Sequence
  synthetic [barcode part2]
cagtgcgactac

SEQ ID NO: 45646 - DNA, 12 bp, Artificial Sequence
  synthetic [barcode part2]
ttatgcggaccg

SEQ ID NO: 45647 - DNA, 12 bp, Artificial Sequence
  synthetic [barcode part2]
atagattgtcgc

SEQ ID NO: 45648 - DNA, 12 bp, Artificial Sequence
  synthetic [barcode part2]
acgttgaaccgc

SEQ ID NO: 45649 - DNA, 12 bp, Artificial Sequence
  synthetic [barcode part2]
acgtcaacggtc

SEQ ID NO: 45650 - DNA, 12 bp, Artificial Sequence
  synthetic [barcode part2]
ccatgcgaactg

SEQ ID NO: 45651 - DNA, 12 bp, Artificial Sequence
  synthetic [barcode part2]
ttcgttacggtc

SEQ ID NO: 45652 - DNA, 12 bp, Artificial Sequence
  synthetic [barcode part2]
ttagaccacatg

SEQ ID NO: 45653 - DNA, 12 bp, Artificial Sequence
  synthetic [barcode part2]
cgacatagttac

SEQ ID NO: 45654 - DNA, 12 bp, Artificial Sequence
  synthetic [barcode part2]
ttactctcgacg

SEQ ID NO: 45655 - DNA, 12 bp, Artificial Sequence
  synthetic [barcode part2]
tcgccagacatg

SEQ ID NO: 45656 - DNA, 12 bp, Artificial Sequence
  synthetic [barcode part2]
tccgtatcacgt

SEQ ID NO: 45657 - DNA, 12 bp, Artificial Sequence
  synthetic [barcode part2]
cgtcaataatcg

SEQ ID NO: 45658 - DNA, 12 bp, Artificial Sequence
  synthetic [barcode part2]
tctcggtactac

SEQ ID NO: 45659 - DNA, 12 bp, Artificial Sequence
  synthetic [barcode part2]
caagtcgcgcat

SEQ ID NO: 45660 - DNA, 12 bp, Artificial Sequence
  synthetic [barcode part2]
tctaccgtagtc

SEQ ID NO: 45661 - DNA, 12 bp, Artificial Sequence
  synthetic [barcode part2]
cgagtcggtatc

SEQ ID NO: 45662 - DNA, 12 bp, Artificial Sequence
  synthetic [barcode part2]
atagttaccgac

SEQ ID NO: 45663 - DNA, 12 bp, Artificial Sequence
  synthetic [barcode part2]
agaatcacggtg

SEQ ID NO: 45664 - DNA, 12 bp, Artificial Sequence
  synthetic [barcode part2]
atacggtaactc

SEQ ID NO: 45665 - DNA, 12 bp, Artificial Sequence
  synthetic [barcode part2]
cgaactacacgc

SEQ ID NO: 45666 - DNA, 12 bp, Artificial Sequence
  synthetic [barcode part2]
ccagtataatcg

SEQ ID NO: 45667 - DNA, 12 bp, Artificial Sequence
  synthetic [barcode part2]
atgccgaattgt

SEQ ID NO: 45668 - DNA, 12 bp, Artificial Sequence
  synthetic [barcode part2]
tcgttgagtgcg

SEQ ID NO: 45669 - DNA, 12 bp, Artificial Sequence
  synthetic [barcode part2]
attcggtgcgtg

SEQ ID NO: 45670 - DNA, 12 bp, Artificial Sequence
  synthetic [barcode part2]
ttctaacaccgc

SEQ ID NO: 45671 - DNA, 12 bp, Artificial Sequence
  synthetic [barcode part2]
atgcggtccgat

SEQ ID NO: 45672 - DNA, 12 bp, Artificial Sequence
  synthetic [barcode part2]
acactggaccgt

SEQ ID NO: 45673 - DNA, 12 bp, Artificial Sequence
  synthetic [barcode part2]
atacggtctaac

SEQ ID NO: 45674 - DNA, 12 bp, Artificial Sequence
  synthetic [barcode part2]
tgccaatgaccg

SEQ ID NO: 45675 - DNA, 12 bp, Artificial Sequence
  synthetic [barcode part2]
cgagttacatac

SEQ ID NO: 45676 - DNA, 12 bp, Artificial Sequence
  synthetic [barcode part2]
acaccagattgt

SEQ ID NO: 45677 - DNA, 12 bp, Artificial Sequence
  synthetic [barcode part2]
atagtcggattc

SEQ ID NO: 45678 - DNA, 12 bp, Artificial Sequence
  synthetic [barcode part2]
atgccgataact

SEQ ID NO: 45679 - DNA, 12 bp, Artificial Sequence
  synthetic [barcode part2]
caacgaccatat

SEQ ID NO: 45680 - DNA, 12 bp, Artificial Sequence
  synthetic [barcode part2]
tccactaaccgt

SEQ ID NO: 45681 - DNA, 12 bp, Artificial Sequence
  synthetic [barcode part2]
agatcggagttg

SEQ ID NO: 45682 - DNA, 12 bp, Artificial Sequence
  synthetic [barcode part2]
cggtcaacttct

SEQ ID NO: 45683 - DNA, 12 bp, Artificial Sequence
  synthetic [barcode part2]
cgtcatacttcg

SEQ ID NO: 45684 - DNA, 12 bp, Artificial Sequence
  synthetic [barcode part2]
caacgtgaccgt

SEQ ID NO: 45685 - DNA, 12 bp, Artificial Sequence
  synthetic [barcode part2]
cagtgtaaccgc

SEQ ID NO: 45686 - DNA, 12 bp, Artificial Sequence
  synthetic [barcode part2]
tctgccatgatc

SEQ ID NO: 45687 - DNA, 12 bp, Artificial Sequence
  synthetic [barcode part2]
tggtgcgtagtc

SEQ ID NO: 45688 - DNA, 12 bp, Artificial Sequence
  synthetic [barcode part2]
tattggcgattg

SEQ ID NO: 45689 - DNA, 12 bp, Artificial Sequence
  synthetic [barcode part2]
tgcactagattg

SEQ ID NO: 45690 - DNA, 12 bp, Artificial Sequence
  synthetic [barcode part2]
acgtcggatcac

SEQ ID NO: 45691 - DNA, 12 bp, Artificial Sequence
  synthetic [barcode part2]
ttcgtcgatcac

SEQ ID NO: 45692 - DNA, 12 bp, Artificial Sequence
  synthetic [barcode part2]
cgatgtatgatc

SEQ ID NO: 45693 - DNA, 12 bp, Artificial Sequence
  synthetic [barcode part2]
accatactagtg

SEQ ID NO: 45694 - DNA, 12 bp, Artificial Sequence
  synthetic [barcode part2]
tggtgtacggtc

SEQ ID NO: 45695 - DNA, 12 bp, Artificial Sequence
  synthetic [barcode part2]
cgaacgcactac

SEQ ID NO: 45696 - DNA, 12 bp, Artificial Sequence
  synthetic [barcode part2]
tctatcaaccgc

SEQ ID NO: 45697 - DNA, 12 bp, Artificial Sequence
  synthetic [barcode part2]
agttacaccgat

SEQ ID NO: 45698 - DNA, 12 bp, Artificial Sequence
  synthetic [barcode part2]
cgagttatgcgc

SEQ ID NO: 45699 - DNA, 12 bp, Artificial Sequence
  synthetic [barcode part2]
tgccggtaactg

SEQ ID NO: 45700 - DNA, 12 bp, Artificial Sequence
  synthetic [barcode part2]
tatggtctagtg

SEQ ID NO: 45701 - DNA, 12 bp, Artificial Sequence
  synthetic [barcode part2]
atgaccgtcggt

SEQ ID NO: 45702 - DNA, 12 bp, Artificial Sequence
  synthetic [barcode part2]
ttacggtcttcg

SEQ ID NO: 45703 - DNA, 12 bp, Artificial Sequence
  synthetic [barcode part2]
tcggttattccg

SEQ ID NO: 45704 - DNA, 12 bp, Artificial Sequence
  synthetic [barcode part2]
ttcgcacgtatc

SEQ ID NO: 45705 - DNA, 12 bp, Artificial Sequence
  synthetic [barcode part2]
ttcggaactctc

SEQ ID NO: 45706 - DNA, 12 bp, Artificial Sequence
  synthetic [barcode part2]
tgaacgcaccgt

SEQ ID NO: 45707 - DNA, 12 bp, Artificial Sequence
  synthetic [barcode part2]
aacgtgcggtct

SEQ ID NO: 45708 - DNA, 12 bp, Artificial Sequence
  synthetic [barcode part2]
tccgttagtcgt

SEQ ID NO: 45709 - DNA, 12 bp, Artificial Sequence
  synthetic [barcode part2]
cgacgactacac

SEQ ID NO: 45710 - DNA, 12 bp, Artificial Sequence
  synthetic [barcode part2]
cggtatggttat

SEQ ID NO: 45711 - DNA, 12 bp, Artificial Sequence
  synthetic [barcode part2]
acggtatgagac

SEQ ID NO: 45712 - DNA, 12 bp, Artificial Sequence
  synthetic [barcode part2]
acggttagattc

SEQ ID NO: 45713 - DNA, 12 bp, Artificial Sequence
  synthetic [barcode part2]
cggtgatcgtgt

SEQ ID NO: 45714 - DNA, 12 bp, Artificial Sequence
  synthetic [barcode part2]
ttctatgcacgc

SEQ ID NO: 45715 - DNA, 12 bp, Artificial Sequence
  synthetic [barcode part2]
cgatagttacac

SEQ ID NO: 45716 - DNA, 12 bp, Artificial Sequence
  synthetic [barcode part2]
tgacacggttat

SEQ ID NO: 45717 - DNA, 12 bp, Artificial Sequence
  synthetic [barcode part2]
cgacgtgtagtc

SEQ ID NO: 45718 - DNA, 12 bp, Artificial Sequence
  synthetic [barcode part2]
attaccggtatg

SEQ ID NO: 45719 - DNA, 12 bp, Artificial Sequence
  synthetic [barcode part2]
ttccggtcaatc

SEQ ID NO: 45720 - DNA, 12 bp, Artificial Sequence
  synthetic [barcode part2]
cgacaatcatac

SEQ ID NO: 45721 - DNA, 12 bp, Artificial Sequence
  synthetic [barcode part2]
atagaccgttac

SEQ ID NO: 45722 - DNA, 12 bp, Artificial Sequence
  synthetic [barcode part2]
cgatgtagtcgc

SEQ ID NO: 45723 - DNA, 12 bp, Artificial Sequence
  synthetic [barcode part2]
tccgattctggt

SEQ ID NO: 45724 - DNA, 12 bp, Artificial Sequence
  synthetic [barcode part2]
acggaccactac

SEQ ID NO: 45725 - DNA, 12 bp, Artificial Sequence
  synthetic [barcode part2]
tctgtcgattgc

SEQ ID NO: 45726 - DNA, 12 bp, Artificial Sequence
  synthetic [barcode part2]
caccaataactg

SEQ ID NO: 45727 - DNA, 12 bp, Artificial Sequence
  synthetic [barcode part2]
agtacatctggt

SEQ ID NO: 45728 - DNA, 12 bp, Artificial Sequence
  synthetic [barcode part2]
tgaccagtctct

SEQ ID NO: 45729 - DNA, 12 bp, Artificial Sequence
  synthetic [barcode part2]
ataccagactac

SEQ ID NO: 45730 - DNA, 12 bp, Artificial Sequence
  synthetic [barcode part2]
acagtcgtcggt

SEQ ID NO: 45731 - DNA, 12 bp, Artificial Sequence
  synthetic [barcode part2]
attgtcgacatg

SEQ ID NO: 45732 - DNA, 12 bp, Artificial Sequence
  synthetic [barcode part2]
taacggtcatac

SEQ ID NO: 45733 - DNA, 12 bp, Artificial Sequence
  synthetic [barcode part2]
tatcgacaactg

SEQ ID NO: 45734 - DNA, 12 bp, Artificial Sequence
  synthetic [barcode part2]
tggactacgcac

SEQ ID NO: 45735 - DNA, 12 bp, Artificial Sequence
  synthetic [barcode part2]
tccgtgccatat

SEQ ID NO: 45736 - DNA, 12 bp, Artificial Sequence
  synthetic [barcode part2]
aaccggtgaagt

SEQ ID NO: 45737 - DNA, 12 bp, Artificial Sequence
  synthetic [barcode part2]
acggttattgac

SEQ ID NO: 45738 - DNA, 12 bp, Artificial Sequence
  synthetic [barcode part2]
tgacgcaatcat

SEQ ID NO: 45739 - DNA, 12 bp, Artificial Sequence
  synthetic [barcode part2]
ttccgacactac

SEQ ID NO: 45740 - DNA, 12 bp, Artificial Sequence
  synthetic [barcode part2]
taagtgcattgc

SEQ ID NO: 45741 - DNA, 12 bp, Artificial Sequence
  synthetic [barcode part2]
tggtagtacatc

SEQ ID NO: 45742 - DNA, 12 bp, Artificial Sequence
  synthetic [barcode part2]
tcttacacacgc

SEQ ID NO: 45743 - DNA, 12 bp, Artificial Sequence
  synthetic [barcode part2]
taagtgccggtc

SEQ ID NO: 45744 - DNA, 12 bp, Artificial Sequence
  synthetic [barcode part2]
accgccaatgtg

SEQ ID NO: 45745 - DNA, 12 bp, Artificial Sequence
  synthetic [barcode part2]
caccatactctg

SEQ ID NO: 45746 - DNA, 12 bp, Artificial Sequence
  synthetic [barcode part2]
cggtgcgattgt

SEQ ID NO: 45747 - DNA, 12 bp, Artificial Sequence
  synthetic [barcode part2]
aacgtatctggt

SEQ ID NO: 45748 - DNA, 12 bp, Artificial Sequence
  synthetic [barcode part2]
tgaaccgcacgt

SEQ ID NO: 45749 - DNA, 12 bp, Artificial Sequence
  synthetic [barcode part2]
tccgccaatcat

SEQ ID NO: 45750 - DNA, 12 bp, Artificial Sequence
  synthetic [barcode part2]
tatcgcacttcg

SEQ ID NO: 45751 - DNA, 12 bp, Artificial Sequence
  synthetic [barcode part2]
cggtgtacgact

SEQ ID NO: 45752 - DNA, 12 bp, Artificial Sequence
  synthetic [barcode part2]
tgaatcacgcat

SEQ ID NO: 45753 - DNA, 12 bp, Artificial Sequence
  synthetic [barcode part2]
ttcgcgtcatac

SEQ ID NO: 45754 - DNA, 12 bp, Artificial Sequence
  synthetic [barcode part2]
cggatgtaccgt

SEQ ID NO: 45755 - DNA, 12 bp, Artificial Sequence
  synthetic [barcode part2]
tctgccaactac

SEQ ID NO: 45756 - DNA, 12 bp, Artificial Sequence
  synthetic [barcode part2]
atggtcgaatct

SEQ ID NO: 45757 - DNA, 12 bp, Artificial Sequence
  synthetic [barcode part2]
agtcatactggt

SEQ ID NO: 45758 - DNA, 12 bp, Artificial Sequence
  synthetic [barcode part2]
accgattcttcg

SEQ ID NO: 45759 - DNA, 12 bp, Artificial Sequence
  synthetic [barcode part2]
tggcacgattgc

SEQ ID NO: 45760 - DNA, 12 bp, Artificial Sequence
  synthetic [barcode part2]
acagttactggt

SEQ ID NO: 45761 - DNA, 12 bp, Artificial Sequence
  synthetic [barcode part2]
caactggtctct

SEQ ID NO: 45762 - DNA, 12 bp, Artificial Sequence
  synthetic [barcode part2]
tcgtatgaatcg

SEQ ID NO: 45763 - DNA, 12 bp, Artificial Sequence
  synthetic [barcode part2]
tcgacgcagttg

SEQ ID NO: 45764 - DNA, 12 bp, Artificial Sequence
  synthetic [barcode part2]
cgtaccgaatcg

SEQ ID NO: 45765 - DNA, 12 bp, Artificial Sequence
  synthetic [barcode part2]
agacacggtatg

SEQ ID NO: 45766 - DNA, 12 bp, Artificial Sequence
  synthetic [barcode part2]
tggcatatagtc

SEQ ID NO: 45767 - DNA, 12 bp, Artificial Sequence
  synthetic [barcode part2]
tggtatggtcgc

SEQ ID NO: 45768 - DNA, 12 bp, Artificial Sequence
  synthetic [barcode part2]
aactacaccagt

SEQ ID NO: 45769 - DNA, 12 bp, Artificial Sequence
  synthetic [barcode part2]
tggtatgactac

SEQ ID NO: 45770 - DNA, 12 bp, Artificial Sequence
  synthetic [barcode part2]
acgaccgttgac

SEQ ID NO: 45771 - DNA, 12 bp, Artificial Sequence
  synthetic [barcode part2]
ccatatggaccg

SEQ ID NO: 45772 - DNA, 12 bp, Artificial Sequence
  synthetic [barcode part2]
ttcatactgcgc

SEQ ID NO: 45773 - DNA, 12 bp, Artificial Sequence
  synthetic [barcode part2]
ttccggtgttac

SEQ ID NO: 45774 - DNA, 12 bp, Artificial Sequence
  synthetic [barcode part2]
taacgtgactac

SEQ ID NO: 45775 - DNA, 12 bp, Artificial Sequence
  synthetic [barcode part2]
aagtgcggtatg

SEQ ID NO: 45776 - DNA, 12 bp, Artificial Sequence
  synthetic [barcode part2]
tagtcggagagt

SEQ ID NO: 45777 - DNA, 12 bp, Artificial Sequence
  synthetic [barcode part2]
ttagattacgcg

SEQ ID NO: 45778 - DNA, 12 bp, Artificial Sequence
  synthetic [barcode part2]
agtcacgtcggt

SEQ ID NO: 45779 - DNA, 12 bp, Artificial Sequence
  synthetic [barcode part2]
aaccgacgagat

SEQ ID NO: 45780 - DNA, 12 bp, Artificial Sequence
  synthetic [barcode part2]
tctcggttgatc

SEQ ID NO: 45781 - DNA, 12 bp, Artificial Sequence
  synthetic [barcode part2]
ttagaagtggcg

SEQ ID NO: 45782 - DNA, 12 bp, Artificial Sequence
  synthetic [barcode part2]
taacgcagttac

SEQ ID NO: 45783 - DNA, 12 bp, Artificial Sequence
  synthetic [barcode part2]
tagattgcgcat

SEQ ID NO: 45784 - DNA, 12 bp, Artificial Sequence
  synthetic [barcode part2]
tgacgcacgact

SEQ ID NO: 45785 - DNA, 12 bp, Artificial Sequence
  synthetic [barcode part2]
accataccgacg

SEQ ID NO: 45786 - DNA, 12 bp, Artificial Sequence
  synthetic [barcode part2]
accagagaactg

SEQ ID NO: 45787 - DNA, 12 bp, Artificial Sequence
  synthetic [barcode part2]
ttcggtctcaac

SEQ ID NO: 45788 - DNA, 12 bp, Artificial Sequence
  synthetic [barcode part2]
attcggtatacg

SEQ ID NO: 45789 - DNA, 12 bp, Artificial Sequence
  synthetic [barcode part2]
cggttagagagt

SEQ ID NO: 45790 - DNA, 12 bp, Artificial Sequence
  synthetic [barcode part2]
acatgattcggt

SEQ ID NO: 45791 - DNA, 12 bp, Artificial Sequence
  synthetic [barcode part2]
acagaccatcat

SEQ ID NO: 45792 - DNA, 12 bp, Artificial Sequence
  synthetic [barcode part2]
atggttatcggt

SEQ ID NO: 45793 - DNA, 12 bp, Artificial Sequence
  synthetic [barcode part2]
ttacgtgaatcg

SEQ ID NO: 45794 - DNA, 12 bp, Artificial Sequence
  synthetic [barcode part2]
tctcatacgcac

SEQ ID NO: 45795 - DNA, 12 bp, Artificial Sequence
  synthetic [barcode part2]
tggatcacatac

SEQ ID NO: 45796 - DNA, 12 bp, Artificial Sequence
  synthetic [barcode part2]
tatctaacgacg

SEQ ID NO: 45797 - DNA, 12 bp, Artificial Sequence
  synthetic [barcode part2]
tgatagtcgcat

SEQ ID NO: 45798 - DNA, 12 bp, Artificial Sequence
  synthetic [barcode part2]
tggtgatcgcac

SEQ ID NO: 45799 - DNA, 12 bp, Artificial Sequence
  synthetic [barcode part2]
ttaccgagtgcg

SEQ ID NO: 45800 - DNA, 12 bp, Artificial Sequence
  synthetic [barcode part2]
cggtacaactat

SEQ ID NO: 45801 - DNA, 12 bp, Artificial Sequence
  synthetic [barcode part2]
tcggcacaatcg

SEQ ID NO: 45802 - DNA, 12 bp, Artificial Sequence
  synthetic [barcode part2]
taatgatcgtgc

SEQ ID NO: 45803 - DNA, 12 bp, Artificial Sequence
  synthetic [barcode part2]
cgacggttatgc

SEQ ID NO: 45804 - DNA, 12 bp, Artificial Sequence
  synthetic [barcode part2]
ttagtgcagttg

SEQ ID NO: 45805 - DNA, 12 bp, Artificial Sequence
  synthetic [barcode part2]
atatcggcggtc

SEQ ID NO: 45806 - DNA, 12 bp, Artificial Sequence
  synthetic [barcode part2]
tccgcgtatact

SEQ ID NO: 45807 - DNA, 12 bp, Artificial Sequence
  synthetic [barcode part2]
taacgtgtgatc

SEQ ID NO: 45808 - DNA, 12 bp, Artificial Sequence
  synthetic [barcode part2]
taagaccgagac

SEQ ID NO: 45809 - DNA, 12 bp, Artificial Sequence
  synthetic [barcode part2]
ttccgtgacatc

SEQ ID NO: 45810 - DNA, 12 bp, Artificial Sequence
  synthetic [barcode part2]
tcttgatcggtc

SEQ ID NO: 45811 - DNA, 12 bp, Artificial Sequence
  synthetic [barcode part2]
ttattgaacgcg

SEQ ID NO: 45812 - DNA, 12 bp, Artificial Sequence
  synthetic [barcode part2]
tgcggtctaacg

SEQ ID NO: 45813 - DNA, 12 bp, Artificial Sequence
  synthetic [barcode part2]
aatgaccacatc

SEQ ID NO: 45814 - DNA, 12 bp, Artificial Sequence
  synthetic [barcode part2]
accaccgacatg

SEQ ID NO: 45815 - DNA, 12 bp, Artificial Sequence
  synthetic [barcode part2]
tagtaacgcact

SEQ ID NO: 45816 - DNA, 12 bp, Artificial Sequence
  synthetic [barcode part2]
ttaccgaacatg

SEQ ID NO: 45817 - DNA, 12 bp, Artificial Sequence
  synthetic [barcode part2]
tcgatacaactg

SEQ ID NO: 45818 - DNA, 12 bp, Artificial Sequence
  synthetic [barcode part2]
agaagttggtcg

SEQ ID NO: 45819 - DNA, 12 bp, Artificial Sequence
  synthetic [barcode part2]
agttctcaccgt

SEQ ID NO: 45820 - DNA, 12 bp, Artificial Sequence
  synthetic [barcode part2]
aattcggtatgc

SEQ ID NO: 45821 - DNA, 12 bp, Artificial Sequence
  synthetic [barcode part2]
ttagaccgtgcg

SEQ ID NO: 45822 - DNA, 12 bp, Artificial Sequence
  synthetic [barcode part2]
tgacgacgcact

SEQ ID NO: 45823 - DNA, 12 bp, Artificial Sequence
  synthetic [barcode part2]
tcttgatgccac

SEQ ID NO: 45824 - DNA, 12 bp, Artificial Sequence
  synthetic [barcode part2]
cgttgatggtcg

SEQ ID NO: 45825 - DNA, 12 bp, Artificial Sequence
  synthetic [barcode part2]
cggtgtaatcat

SEQ ID NO: 45826 - DNA, 12 bp, Artificial Sequence
  synthetic [barcode part2]
caatacaaccgt

SEQ ID NO: 45827 - DNA, 12 bp, Artificial Sequence
  synthetic [barcode part2]
tgcaatccgacg

SEQ ID NO: 45828 - DNA, 12 bp, Artificial Sequence
  synthetic [barcode part2]
ttccatacgtgc

SEQ ID NO: 45829 - DNA, 12 bp, Artificial Sequence
  synthetic [barcode part2]
tccatgtcgcat

SEQ ID NO: 45830 - DNA, 12 bp, Artificial Sequence
  synthetic [barcode part2]
tggatgtactac

SEQ ID NO: 45831 - DNA, 12 bp, Artificial Sequence
  synthetic [barcode part2]
ttagtcgttccg

SEQ ID NO: 45832 - DNA, 12 bp, Artificial Sequence
  synthetic [barcode part2]
accactaacgcg

SEQ ID NO: 45833 - DNA, 12 bp, Artificial Sequence
  synthetic [barcode part2]
cagtacacggtc

SEQ ID NO: 45834 - DNA, 12 bp, Artificial Sequence
  synthetic [barcode part2]
cgtgattcggtg

SEQ ID NO: 45835 - DNA, 12 bp, Artificial Sequence
  synthetic [barcode part2]
tgcaatctagtg

SEQ ID NO: 45836 - DNA, 12 bp, Artificial Sequence
  synthetic [barcode part2]
tagatgtgccat

SEQ ID NO: 45837 - DNA, 12 bp, Artificial Sequence
  synthetic [barcode part2]
tggaatcggaac

SEQ ID NO: 45838 - DNA, 12 bp, Artificial Sequence
  synthetic [barcode part2]
tctcttcggaac

SEQ ID NO: 45839 - DNA, 12 bp, Artificial Sequence
  synthetic [barcode part2]
tattcggtagtg

SEQ ID NO: 45840 - DNA, 12 bp, Artificial Sequence
  synthetic [barcode part2]
cgacggtatgtc

SEQ ID NO: 45841 - DNA, 12 bp, Artificial Sequence
  synthetic [barcode part2]
cggcggtcatat

SEQ ID NO: 45842 - DNA, 12 bp, Artificial Sequence
  synthetic [barcode part2]
aaccgcattagt

SEQ ID NO: 45843 - DNA, 12 bp, Artificial Sequence
  synthetic [barcode part2]
tcgaactgcgtg

SEQ ID NO: 45844 - DNA, 12 bp, Artificial Sequence
  synthetic [barcode part2]
ccaccagatacg

SEQ ID NO: 45845 - DNA, 12 bp, Artificial Sequence
  synthetic [barcode part2]
taagttacgcac

SEQ ID NO: 45846 - DNA, 12 bp, Artificial Sequence
  synthetic [barcode part2]
tcgattgtctcg

SEQ ID NO: 45847 - DNA, 12 bp, Artificial Sequence
  synthetic [barcode part2]
cgaacataccgc

SEQ ID NO: 45848 - DNA, 12 bp, Artificial Sequence
  synthetic [barcode part2]
tagatcacgtgt

SEQ ID NO: 45849 - DNA, 12 bp, Artificial Sequence
  synthetic [barcode part2]
tggcgacacatc

SEQ ID NO: 45850 - DNA, 12 bp, Artificial Sequence
  synthetic [barcode part2]
ttcttccgagac

SEQ ID NO: 45851 - DNA, 12 bp, Artificial Sequence
  synthetic [barcode part2]
tggcgtggttac

SEQ ID NO: 45852 - DNA, 12 bp, Artificial Sequence
  synthetic [barcode part2]
tggattggtatc

SEQ ID NO: 45853 - DNA, 12 bp, Artificial Sequence
  synthetic [barcode part2]
tgagtcgtgcgt

SEQ ID NO: 45854 - DNA, 12 bp, Artificial Sequence
  synthetic [barcode part2]
cgtatcagaccg

SEQ ID NO: 45855 - DNA, 12 bp, Artificial Sequence
  synthetic [barcode part2]
taagtcgcgtgc

SEQ ID NO: 45856 - DNA, 12 bp, Artificial Sequence
  synthetic [barcode part2]
ttacttccggtg

SEQ ID NO: 45857 - DNA, 12 bp, Artificial Sequence
  synthetic [barcode part2]
cgtgagaatacg

SEQ ID NO: 45858 - DNA, 12 bp, Artificial Sequence
  synthetic [barcode part2]
acaaccgtcaat

SEQ ID NO: 45859 - DNA, 12 bp, Artificial Sequence
  synthetic [barcode part2]
tctataccacgc

SEQ ID NO: 45860 - DNA, 12 bp, Artificial Sequence
  synthetic [barcode part2]
ttatcggatgtg

SEQ ID NO: 45861 - DNA, 12 bp, Artificial Sequence
  synthetic [barcode part2]
agtctctaccgt

SEQ ID NO: 45862 - DNA, 12 bp, Artificial Sequence
  synthetic [barcode part2]
agacggttagtg

SEQ ID NO: 45863 - DNA, 12 bp, Artificial Sequence
  synthetic [barcode part2]
accacattggcg

SEQ ID NO: 45864 - DNA, 12 bp, Artificial Sequence
  synthetic [barcode part2]
ttccaatgccac

SEQ ID NO: 45865 - DNA, 12 bp, Artificial Sequence
  synthetic [barcode part2]
taagtcggcgtc

SEQ ID NO: 45866 - DNA, 12 bp, Artificial Sequence
  synthetic [barcode part2]
tgcgttagaccg

SEQ ID NO: 45867 - DNA, 12 bp, Artificial Sequence
  synthetic [barcode part2]
acgactaccgac

SEQ ID NO: 45868 - DNA, 12 bp, Artificial Sequence
  synthetic [barcode part2]
cggtatgaccgt

SEQ ID NO: 45869 - DNA, 12 bp, Artificial Sequence
  synthetic [barcode part2]
tggtgattatgc

SEQ ID NO: 45870 - DNA, 12 bp, Artificial Sequence
  synthetic [barcode part2]
accgaagaatcg

SEQ ID NO: 45871 - DNA, 12 bp, Artificial Sequence
  synthetic [barcode part2]
tgaacgcgttat

SEQ ID NO: 45872 - DNA, 12 bp, Artificial Sequence
  synthetic [barcode part2]
ttccgcatgtac

SEQ ID NO: 45873 - DNA, 12 bp, Artificial Sequence
  synthetic [barcode part2]
tctcgacgttac

SEQ ID NO: 45874 - DNA, 12 bp, Artificial Sequence
  synthetic [barcode part2]
ccaatgtgaccg

SEQ ID NO: 45875 - DNA, 12 bp, Artificial Sequence
  synthetic [barcode part2]
tgcagttcaatg

SEQ ID NO: 45876 - DNA, 12 bp, Artificial Sequence
  synthetic [barcode part2]
ttaagttgtgcg

SEQ ID NO: 45877 - DNA, 12 bp, Artificial Sequence
  synthetic [barcode part2]
tcttggcatcac

SEQ ID NO: 45878 - DNA, 12 bp, Artificial Sequence
  synthetic [barcode part2]
tagttccggtct

SEQ ID NO: 45879 - DNA, 12 bp, Artificial Sequence
  synthetic [barcode part2]
ataccagtgatc

SEQ ID NO: 45880 - DNA, 12 bp, Artificial Sequence
  synthetic [barcode part2]
ttactggatacg

SEQ ID NO: 45881 - DNA, 12 bp, Artificial Sequence
  synthetic [barcode part2]
tccaccgactat

SEQ ID NO: 45882 - DNA, 12 bp, Artificial Sequence
  synthetic [barcode part2]
tattcggcgacg

SEQ ID NO: 45883 - DNA, 12 bp, Artificial Sequence
  synthetic [barcode part2]
attgcactagtg

SEQ ID NO: 45884 - DNA, 12 bp, Artificial Sequence
  synthetic [barcode part2]
aagtaaccggtg

SEQ ID NO: 45885 - DNA, 12 bp, Artificial Sequence
  synthetic [barcode part2]
attcttcgaccg

SEQ ID NO: 45886 - DNA, 12 bp, Artificial Sequence
  synthetic [barcode part2]
tggcgaccatac

SEQ ID NO: 45887 - DNA, 12 bp, Artificial Sequence
  synthetic [barcode part2]
tatcacgttccg

SEQ ID NO: 45888 - DNA, 12 bp, Artificial Sequence
  synthetic [barcode part2]
ttcgcgtacatc

SEQ ID NO: 45889 - DNA, 12 bp, Artificial Sequence
  synthetic [barcode part2]
tcgtgtagaccg

SEQ ID NO: 45890 - DNA, 12 bp, Artificial Sequence
  synthetic [barcode part2]
ccaactactctg

SEQ ID NO: 45891 - DNA, 12 bp, Artificial Sequence
  synthetic [barcode part2]
tggcaattacac

SEQ ID NO: 45892 - DNA, 12 bp, Artificial Sequence
  synthetic [barcode part2]
tagtgcgaccgt

SEQ ID NO: 45893 - DNA, 12 bp, Artificial Sequence
  synthetic [barcode part2]
acacggtccagt

SEQ ID NO: 45894 - DNA, 12 bp, Artificial Sequence
  synthetic [barcode part2]
ttccaatcggtc

SEQ ID NO: 45895 - DNA, 12 bp, Artificial Sequence
  synthetic [barcode part2]
tggaccgtacac

SEQ ID NO: 45896 - DNA, 12 bp, Artificial Sequence
  synthetic [barcode part2]
ttctggcattgc

SEQ ID NO: 45897 - DNA, 12 bp, Artificial Sequence
  synthetic [barcode part2]
caagaccgaagt

SEQ ID NO: 45898 - DNA, 12 bp, Artificial Sequence
  synthetic [barcode part2]
tccacattgcgt

SEQ ID NO: 45899 - DNA, 12 bp, Artificial Sequence
  synthetic [barcode part2]
cggagttgagat

SEQ ID NO: 45900 - DNA, 12 bp, Artificial Sequence
  synthetic [barcode part2]
aacagttgcact

SEQ ID NO: 45901 - DNA, 12 bp, Artificial Sequence
  synthetic [barcode part2]
taacacgatcac

SEQ ID NO: 45902 - DNA, 12 bp, Artificial Sequence
  synthetic [barcode part2]
acaccgaatcat

SEQ ID NO: 45903 - DNA, 12 bp, Artificial Sequence
  synthetic [barcode part2]
cagaccggtatc

SEQ ID NO: 45904 - DNA, 12 bp, Artificial Sequence
  synthetic [barcode part2]
tcggtgcgattg

SEQ ID NO: 45905 - DNA, 12 bp, Artificial Sequence
  synthetic [barcode part2]
taacgactgtac

SEQ ID NO: 45906 - DNA, 12 bp, Artificial Sequence
  synthetic [barcode part2]
agttcggtgtat

SEQ ID NO: 45907 - DNA, 12 bp, Artificial Sequence
  synthetic [barcode part2]
tctcgtgtgtac

SEQ ID NO: 45908 - DNA, 12 bp, Artificial Sequence
  synthetic [barcode part2]
tgacgactatgt

SEQ ID NO: 45909 - DNA, 12 bp, Artificial Sequence
  synthetic [barcode part2]
ttccgtgcatac

SEQ ID NO: 45910 - DNA, 12 bp, Artificial Sequence
  synthetic [barcode part2]
taatgcggccac

SEQ ID NO: 45911 - DNA, 12 bp, Artificial Sequence
  synthetic [barcode part2]
tcgcatagattg

SEQ ID NO: 45912 - DNA, 12 bp, Artificial Sequence
  synthetic [barcode part2]
tctcgcaacatc

SEQ ID NO: 45913 - DNA, 12 bp, Artificial Sequence
  synthetic [barcode part2]
acgttgacaatc

SEQ ID NO: 45914 - DNA, 12 bp, Artificial Sequence
  synthetic [barcode part2]
taacgacgtatc

SEQ ID NO: 45915 - DNA, 12 bp, Artificial Sequence
  synthetic [barcode part2]
atacggttcggc

SEQ ID NO: 45916 - DNA, 12 bp, Artificial Sequence
  synthetic [barcode part2]
ataccgaaccgc

SEQ ID NO: 45917 - DNA, 12 bp, Artificial Sequence
  synthetic [barcode part2]
cggatcatgtat

SEQ ID NO: 45918 - DNA, 12 bp, Artificial Sequence
  synthetic [barcode part2]
aatctggcgtgc

SEQ ID NO: 45919 - DNA, 12 bp, Artificial Sequence
  synthetic [barcode part2]
tgatggccacgt

SEQ ID NO: 45920 - DNA, 12 bp, Artificial Sequence
  synthetic [barcode part2]
tccataccgtgt

SEQ ID NO: 45921 - DNA, 12 bp, Artificial Sequence
  synthetic [barcode part2]
cgtcggtgattg

SEQ ID NO: 45922 - DNA, 12 bp, Artificial Sequence
  synthetic [barcode part2]
atgtgcgtctct

SEQ ID NO: 45923 - DNA, 12 bp, Artificial Sequence
  synthetic [barcode part2]
tattctcgcgtg

SEQ ID NO: 45924 - DNA, 12 bp, Artificial Sequence
  synthetic [barcode part2]
tgaaccgtgtat

SEQ ID NO: 45925 - DNA, 12 bp, Artificial Sequence
  synthetic [barcode part2]
cggtaactgcgt

SEQ ID NO: 45926 - DNA, 12 bp, Artificial Sequence
  synthetic [barcode part2]
caccatatctcg

SEQ ID NO: 45927 - DNA, 12 bp, Artificial Sequence
  synthetic [barcode part2]
attgccaatacg

SEQ ID NO: 45928 - DNA, 12 bp, Artificial Sequence
  synthetic [barcode part2]
taataactgcgc

SEQ ID NO: 45929 - DNA, 12 bp, Artificial Sequence
  synthetic [barcode part2]
atggcgtgaagt

SEQ ID NO: 45930 - DNA, 12 bp, Artificial Sequence
  synthetic [barcode part2]
cactaacgaccg

SEQ ID NO: 45931 - DNA, 12 bp, Artificial Sequence
  synthetic [barcode part2]
tagtatggccat

SEQ ID NO: 45932 - DNA, 12 bp, Artificial Sequence
  synthetic [barcode part2]
tcgaatcatgtg

SEQ ID NO: 45933 - DNA, 12 bp, Artificial Sequence
  synthetic [barcode part2]
acatggcaatct

SEQ ID NO: 45934 - DNA, 12 bp, Artificial Sequence
  synthetic [barcode part2]
tggattgtgtac

SEQ ID NO: 45935 - DNA, 12 bp, Artificial Sequence
  synthetic [barcode part2]
tggtcaactctc

SEQ ID NO: 45936 - DNA, 12 bp, Artificial Sequence
  synthetic [barcode part2]
ataccgagttac

SEQ ID NO: 45937 - DNA, 12 bp, Artificial Sequence
  synthetic [barcode part2]
tatctggtaacg

SEQ ID NO: 45938 - DNA, 12 bp, Artificial Sequence
  synthetic [barcode part2]
ataaccgagttc

SEQ ID NO: 45939 - DNA, 12 bp, Artificial Sequence
  synthetic [barcode part2]
catcaatgacca

SEQ ID NO: 45940 - DNA, 12 bp, Artificial Sequence
  synthetic [barcode part2]
aaccagcggaat

SEQ ID NO: 45941 - DNA, 12 bp, Artificial Sequence
  synthetic [barcode part2]
cgccggtaatca

SEQ ID NO: 45942 - DNA, 12 bp, Artificial Sequence
  synthetic [barcode part2]
tagaccggtgct

SEQ ID NO: 45943 - DNA, 12 bp, Artificial Sequence
  synthetic [barcode part2]
tccagccaatct

SEQ ID NO: 45944 - DNA, 12 bp, Artificial Sequence
  synthetic [barcode part2]
tatgttaagccg

SEQ ID NO: 45945 - DNA, 12 bp, Artificial Sequence
  synthetic [barcode part2]
tgtggaagtgca

SEQ ID NO: 45946 - DNA, 12 bp, Artificial Sequence
  synthetic [barcode part2]
tcaacatctgga

SEQ ID NO: 45947 - DNA, 12 bp, Artificial Sequence
  synthetic [barcode part2]
tgtggtccaata

SEQ ID NO: 45948 - DNA, 12 bp, Artificial Sequence
  synthetic [barcode part2]
tcactcttggca

SEQ ID NO: 45949 - DNA, 12 bp, Artificial Sequence
  synthetic [barcode part2]
cgcaccggatta

SEQ ID NO: 45950 - DNA, 12 bp, Artificial Sequence
  synthetic [barcode part2]
accatcagcgtg

SEQ ID NO: 45951 - DNA, 12 bp, Artificial Sequence
  synthetic [barcode part2]
tacattgagcca

SEQ ID NO: 45952 - DNA, 12 bp, Artificial Sequence
  synthetic [barcode part2]
tgacatacagct

SEQ ID NO: 45953 - DNA, 12 bp, Artificial Sequence
  synthetic [barcode part2]
ctctaaccagct

SEQ ID NO: 45954 - DNA, 12 bp, Artificial Sequence
  synthetic [barcode part2]
tagcgcaattgt

SEQ ID NO: 45955 - DNA, 12 bp, Artificial Sequence
  synthetic [barcode part2]
tagcggttatgt

SEQ ID NO: 45956 - DNA, 12 bp, Artificial Sequence
  synthetic [barcode part2]
taagccatgcgc

SEQ ID NO: 45957 - DNA, 12 bp, Artificial Sequence
  synthetic [barcode part2]
tgctatgctctg

SEQ ID NO: 45958 - DNA, 12 bp, Artificial Sequence
  synthetic [barcode part2]
ttggaagcggta

SEQ ID NO: 45959 - DNA, 12 bp, Artificial Sequence
  synthetic [barcode part2]
atgaccgctaat

SEQ ID NO: 45960 - DNA, 12 bp, Artificial Sequence
  synthetic [barcode part2]
tgtcacgcttca

SEQ ID NO: 45961 - DNA, 12 bp, Artificial Sequence
  synthetic [barcode part2]
ttggtatctgga

SEQ ID NO: 45962 - DNA, 12 bp, Artificial Sequence
  synthetic [barcode part2]
tctcagcattgc

SEQ ID NO: 45963 - DNA, 12 bp, Artificial Sequence
  synthetic [barcode part2]
tctgattccagc

SEQ ID NO: 45964 - DNA, 12 bp, Artificial Sequence
  synthetic [barcode part2]
ttagcacaactg

SEQ ID NO: 45965 - DNA, 12 bp, Artificial Sequence
  synthetic [barcode part2]
cggattggtgct

SEQ ID NO: 45966 - DNA, 12 bp, Artificial Sequence
  synthetic [barcode part2]
ttgtacaccaga

SEQ ID NO: 45967 - DNA, 12 bp, Artificial Sequence
  synthetic [barcode part2]
tcacgcaccaga

SEQ ID NO: 45968 - DNA, 12 bp, Artificial Sequence
  synthetic [barcode part2]
ttgacgcaatca

SEQ ID NO: 45969 - DNA, 12 bp, Artificial Sequence
  synthetic [barcode part2]
tcatgcgctgga

SEQ ID NO: 45970 - DNA, 12 bp, Artificial Sequence
  synthetic [barcode part2]
ctggtataactg

SEQ ID NO: 45971 - DNA, 12 bp, Artificial Sequence
  synthetic [barcode part2]
ctagtatgacca

SEQ ID NO: 45972 - DNA, 12 bp, Artificial Sequence
  synthetic [barcode part2]
atccacgcggta

SEQ ID NO: 45973 - DNA, 12 bp, Artificial Sequence
  synthetic [barcode part2]
ttcttagccagc

SEQ ID NO: 45974 - DNA, 12 bp, Artificial Sequence
  synthetic [barcode part2]
tcagaccgcgta

SEQ ID NO: 45975 - DNA, 12 bp, Artificial Sequence
  synthetic [barcode part2]
taagtatgctgc

SEQ ID NO: 45976 - DNA, 12 bp, Artificial Sequence
  synthetic [barcode part2]
atccggtgtata

SEQ ID NO: 45977 - DNA, 12 bp, Artificial Sequence
  synthetic [barcode part2]
caagcaccagct

SEQ ID NO: 45978 - DNA, 12 bp, Artificial Sequence
  synthetic [barcode part2]
ctcaactggtct

SEQ ID NO: 45979 - DNA, 12 bp, Artificial Sequence
  synthetic [barcode part2]
tgctagtggctg

SEQ ID NO: 45980 - DNA, 12 bp, Artificial Sequence
  synthetic [barcode part2]
ttcagttccagc

SEQ ID NO: 45981 - DNA, 12 bp, Artificial Sequence
  synthetic [barcode part2]
tgagctggcact

SEQ ID NO: 45982 - DNA, 12 bp, Artificial Sequence
  synthetic [barcode part2]
ttgtatggacca

SEQ ID NO: 45983 - DNA, 12 bp, Artificial Sequence
  synthetic [barcode part2]
ttgagccgcgta

SEQ ID NO: 45984 - DNA, 12 bp, Artificial Sequence
  synthetic [barcode part2]
ttgcagctctca

SEQ ID NO: 45985 - DNA, 12 bp, Artificial Sequence
  synthetic [barcode part2]
taagcacaccgc

SEQ ID NO: 45986 - DNA, 12 bp, Artificial Sequence
  synthetic [barcode part2]
tacgctgttaga

SEQ ID NO: 45987 - DNA, 12 bp, Artificial Sequence
  synthetic [barcode part2]
ctctatggtgct

SEQ ID NO: 45988 - DNA, 12 bp, Artificial Sequence
  synthetic [barcode part2]
catctggtagta

SEQ ID NO: 45989 - DNA, 12 bp, Artificial Sequence
  synthetic [barcode part2]
taagccacatac

SEQ ID NO: 45990 - DNA, 12 bp, Artificial Sequence
  synthetic [barcode part2]
cggtatgtggct

SEQ ID NO: 45991 - DNA, 12 bp, Artificial Sequence
  synthetic [barcode part2]
tgagcgtattgt

SEQ ID NO: 45992 - DNA, 12 bp, Artificial Sequence
  synthetic [barcode part2]
ctacataccaga

SEQ ID NO: 45993 - DNA, 12 bp, Artificial Sequence
  synthetic [barcode part2]
acagccaccagt

SEQ ID NO: 45994 - DNA, 12 bp, Artificial Sequence
  synthetic [barcode part2]
tgtgctggatta

SEQ ID NO: 45995 - DNA, 12 bp, Artificial Sequence
  synthetic [barcode part2]
tggcatagctgc

SEQ ID NO: 45996 - DNA, 12 bp, Artificial Sequence
  synthetic [barcode part2]
catggtccggta

SEQ ID NO: 45997 - DNA, 12 bp, Artificial Sequence
  synthetic [barcode part2]
tgtgccattaga

SEQ ID NO: 45998 - DNA, 12 bp, Artificial Sequence
  synthetic [barcode part2]
ctggttactctg

SEQ ID NO: 45999 - DNA, 12 bp, Artificial Sequence
  synthetic [barcode part2]
tgtggtctggca

SEQ ID NO: 46000 - DNA, 12 bp, Artificial Sequence
  synthetic [barcode part2]
tactagtgacca

SEQ ID NO: 46001 - DNA, 12 bp, Artificial Sequence
  synthetic [barcode part2]
ctagaccgtata

SEQ ID NO: 46002 - DNA, 12 bp, Artificial Sequence
  synthetic [barcode part2]
catgttagacca

SEQ ID NO: 46003 - DNA, 12 bp, Artificial Sequence
  synthetic [barcode part2]
aaccacgctggt

SEQ ID NO: 46004 - DNA, 12 bp, Artificial Sequence
  synthetic [barcode part2]
tgtcagcggcta

SEQ ID NO: 46005 - DNA, 12 bp, Artificial Sequence
  synthetic [barcode part2]
taacagctacac

SEQ ID NO: 46006 - DNA, 12 bp, Artificial Sequence
  synthetic [barcode part2]
tacggtctgata

SEQ ID NO: 46007 - DNA, 12 bp, Artificial Sequence
  synthetic [barcode part2]
tgagctgcgcat

SEQ ID NO: 46008 - DNA, 12 bp, Artificial Sequence
  synthetic [barcode part2]
tatagttcagcg

SEQ ID NO: 46009 - DNA, 12 bp, Artificial Sequence
  synthetic [barcode part2]
cttactaaccgc

SEQ ID NO: 46010 - DNA, 12 bp, Artificial Sequence
  synthetic [barcode part2]
ccggtatagcca

SEQ ID NO: 46011 - DNA, 12 bp, Artificial Sequence
  synthetic [barcode part2]
tacgccagatta

SEQ ID NO: 46012 - DNA, 12 bp, Artificial Sequence
  synthetic [barcode part2]
ctacggtctcta

SEQ ID NO: 46013 - DNA, 12 bp, Artificial Sequence
  synthetic [barcode part2]
ttggccagaaga

SEQ ID NO: 46014 - DNA, 12 bp, Artificial Sequence
  synthetic [barcode part2]
taccagcaacta

SEQ ID NO: 46015 - DNA, 12 bp, Artificial Sequence
  synthetic [barcode part2]
ttgccagcgtga

SEQ ID NO: 46016 - DNA, 12 bp, Artificial Sequence
  synthetic [barcode part2]
taacatagccac

SEQ ID NO: 46017 - DNA, 12 bp, Artificial Sequence
  synthetic [barcode part2]
ataactaccagc

SEQ ID NO: 46018 - DNA, 12 bp, Artificial Sequence
  synthetic [barcode part2]
actattggtgca

SEQ ID NO: 46019 - DNA, 12 bp, Artificial Sequence
  synthetic [barcode part2]
cttataccgtgc

SEQ ID NO: 46020 - DNA, 12 bp, Artificial Sequence
  synthetic [barcode part2]
taccaatggcta

SEQ ID NO: 46021 - DNA, 12 bp, Artificial Sequence
  synthetic [barcode part2]
ttggctgttcca

SEQ ID NO: 46022 - DNA, 12 bp, Artificial Sequence
  synthetic [barcode part2]
tgcttgacagcg

SEQ ID NO: 46023 - DNA, 12 bp, Artificial Sequence
  synthetic [barcode part2]
ctgtacagaccg

SEQ ID NO: 46024 - DNA, 12 bp, Artificial Sequence
  synthetic [barcode part2]
tgctgatgattg

SEQ ID NO: 46025 - DNA, 12 bp, Artificial Sequence
  synthetic [barcode part2]
ttatcaagcgtg

SEQ ID NO: 46026 - DNA, 12 bp, Artificial Sequence
  synthetic [barcode part2]
tatcagcagttg

SEQ ID NO: 46027 - DNA, 12 bp, Artificial Sequence
  synthetic [barcode part2]
tgtaacttggca

SEQ ID NO: 46028 - DNA, 12 bp, Artificial Sequence
  synthetic [barcode part2]
tctacgctacac

SEQ ID NO: 46029 - DNA, 12 bp, Artificial Sequence
  synthetic [barcode part2]
tcatacagacca

SEQ ID NO: 46030 - DNA, 12 bp, Artificial Sequence
  synthetic [barcode part2]
tcaccagtatga

SEQ ID NO: 46031 - DNA, 12 bp, Artificial Sequence
  synthetic [barcode part2]
tcacggtagaga

SEQ ID NO: 46032 - DNA, 12 bp, Artificial Sequence
  synthetic [barcode part2]
ttccagctagtc

SEQ ID NO: 46033 - DNA, 12 bp, Artificial Sequence
  synthetic [barcode part2]
tggacatgctgc

SEQ ID NO: 46034 - DNA, 12 bp, Artificial Sequence
  synthetic [barcode part2]
ccggttagaaga

SEQ ID NO: 46035 - DNA, 12 bp, Artificial Sequence
  synthetic [barcode part2]
tgacagcgtgct

SEQ ID NO: 46036 - DNA, 12 bp, Artificial Sequence
  synthetic [barcode part2]
actgtgccggta

SEQ ID NO: 46037 - DNA, 12 bp, Artificial Sequence
  synthetic [barcode part2]
ttggctgagaga

SEQ ID NO: 46038 - DNA, 12 bp, Artificial Sequence
  synthetic [barcode part2]
tagcagctgtat

SEQ ID NO: 46039 - DNA, 12 bp, Artificial Sequence
  synthetic [barcode part2]
caacggtacgct

SEQ ID NO: 46040 - DNA, 12 bp, Artificial Sequence
  synthetic [barcode part2]
tgtcttcacgca

SEQ ID NO: 46041 - DNA, 12 bp, Artificial Sequence
  synthetic [barcode part2]
taccgtgagaga

SEQ ID NO: 46042 - DNA, 12 bp, Artificial Sequence
  synthetic [barcode part2]
tggcagcatgtc

SEQ ID NO: 46043 - DNA, 12 bp, Artificial Sequence
  synthetic [barcode part2]
tgtgccagacca

SEQ ID NO: 46044 - DNA, 12 bp, Artificial Sequence
  synthetic [barcode part2]
ctatctccggta

SEQ ID NO: 46045 - DNA, 12 bp, Artificial Sequence
  synthetic [barcode part2]
tcaacatggcta

SEQ ID NO: 46046 - DNA, 12 bp, Artificial Sequence
  synthetic [barcode part2]
ttgcacgctgga

SEQ ID NO: 46047 - DNA, 12 bp, Artificial Sequence
  synthetic [barcode part2]
ctaatacggtca

SEQ ID NO: 46048 - DNA, 12 bp, Artificial Sequence
  synthetic [barcode part2]
tcagattgcaca

SEQ ID NO: 46049 - DNA, 12 bp, Artificial Sequence
  synthetic [barcode part2]
tcagcgtagtta

SEQ ID NO: 46050 - DNA, 12 bp, Artificial Sequence
  synthetic [barcode part2]
taacacggctgc

SEQ ID NO: 46051 - DNA, 12 bp, Artificial Sequence
  synthetic [barcode part2]
acggtatagagc

SEQ ID NO: 46052 - DNA, 12 bp, Artificial Sequence
  synthetic [barcode part2]
actcatacggta

SEQ ID NO: 46053 - DNA, 12 bp, Artificial Sequence
  synthetic [barcode part2]
ccgcatagacca

SEQ ID NO: 46054 - DNA, 12 bp, Artificial Sequence
  synthetic [barcode part2]
cttctggttgac

SEQ ID NO: 46055 - DNA, 12 bp, Artificial Sequence
  synthetic [barcode part2]
tgttggcaacta

SEQ ID NO: 46056 - DNA, 12 bp, Artificial Sequence
  synthetic [barcode part2]
acttgcgcggta

SEQ ID NO: 46057 - DNA, 12 bp, Artificial Sequence
  synthetic [barcode part2]
catggtcattga

SEQ ID NO: 46058 - DNA, 12 bp, Artificial Sequence
  synthetic [barcode part2]
tgtctggcagca

SEQ ID NO: 46059 - DNA, 12 bp, Artificial Sequence
  synthetic [barcode part2]
tcacgtgagtta

SEQ ID NO: 46060 - DNA, 12 bp, Artificial Sequence
  synthetic [barcode part2]
ttcagccagttc

SEQ ID NO: 46061 - DNA, 12 bp, Artificial Sequence
  synthetic [barcode part2]
tacattgccaga

SEQ ID NO: 46062 - DNA, 12 bp, Artificial Sequence
  synthetic [barcode part2]
tgttgatctgga

SEQ ID NO: 46063 - DNA, 12 bp, Artificial Sequence
  synthetic [barcode part2]
agttgcgctggt

SEQ ID NO: 46064 - DNA, 12 bp, Artificial Sequence
  synthetic [barcode part2]
ttggtgcggtca

SEQ ID NO: 46065 - DNA, 12 bp, Artificial Sequence
  synthetic [barcode part2]
taagctggtatc

SEQ ID NO: 46066 - DNA, 12 bp, Artificial Sequence
  synthetic [barcode part2]
ttgcgtggatta

SEQ ID NO: 46067 - DNA, 12 bp, Artificial Sequence
  synthetic [barcode part2]
atctgtacggta

SEQ ID NO: 46068 - DNA, 12 bp, Artificial Sequence
  synthetic [barcode part2]
tcatatgagcca

SEQ ID NO: 46069 - DNA, 12 bp, Artificial Sequence
  synthetic [barcode part2]
tggcagctatgc

SEQ ID NO: 46070 - DNA, 12 bp, Artificial Sequence
  synthetic [barcode part2]
atcacgccggta

SEQ ID NO: 46071 - DNA, 12 bp, Artificial Sequence
  synthetic [barcode part2]
tccagagcttct

SEQ ID NO: 46072 - DNA, 12 bp, Artificial Sequence
  synthetic [barcode part2]
aacaccgcttct

SEQ ID NO: 46073 - DNA, 12 bp, Artificial Sequence
  synthetic [barcode part2]
tacaatctggca

SEQ ID NO: 46074 - DNA, 12 bp, Artificial Sequence
  synthetic [barcode part2]
tgtgccaagtta

SEQ ID NO: 46075 - DNA, 12 bp, Artificial Sequence
  synthetic [barcode part2]
tagcatatggct

SEQ ID NO: 46076 - DNA, 12 bp, Artificial Sequence
  synthetic [barcode part2]
tgtgcgtgaaga

SEQ ID NO: 46077 - DNA, 12 bp, Artificial Sequence
  synthetic [barcode part2]
tgtgagagcaca

SEQ ID NO: 46078 - DNA, 12 bp, Artificial Sequence
  synthetic [barcode part2]
taagcacgttac

SEQ ID NO: 46079 - DNA, 12 bp, Artificial Sequence
  synthetic [barcode part2]
tgtgcacagaga

SEQ ID NO: 46080 - DNA, 12 bp, Artificial Sequence
  synthetic [barcode part2]
tagcagcacgct

SEQ ID NO: 46081 - DNA, 12 bp, Artificial Sequence
  synthetic [barcode part2]
tgttgcgtctca

SEQ ID NO: 46082 - DNA, 12 bp, Artificial Sequence
  synthetic [barcode part2]
taccgcagaaga

SEQ ID NO: 46083 - DNA, 12 bp, Artificial Sequence
  synthetic [barcode part2]
actaccgtatga

SEQ ID NO: 46084 - DNA, 12 bp, Artificial Sequence
  synthetic [barcode part2]
tagcgcataact

SEQ ID NO: 46085 - DNA, 12 bp, Artificial Sequence
  synthetic [barcode part2]
ccggtgcttaga

SEQ ID NO: 46086 - DNA, 12 bp, Artificial Sequence
  synthetic [barcode part2]
cgctagtggtca

SEQ ID NO: 46087 - DNA, 12 bp, Artificial Sequence
  synthetic [barcode part2]
ttgaccgcttca

SEQ ID NO: 46088 - DNA, 12 bp, Artificial Sequence
  synthetic [barcode part2]
acacagcggtct

SEQ ID NO: 46089 - DNA, 12 bp, Artificial Sequence
  synthetic [barcode part2]
tatgctgaactg

SEQ ID NO: 46090 - DNA, 12 bp, Artificial Sequence
  synthetic [barcode part2]
actgctggtata

SEQ ID NO: 46091 - DNA, 12 bp, Artificial Sequence
  synthetic [barcode part2]
ttgttccgctga

SEQ ID NO: 46092 - DNA, 12 bp, Artificial Sequence
  synthetic [barcode part2]
ctagaccacgca

SEQ ID NO: 46093 - DNA, 12 bp, Artificial Sequence
  synthetic [barcode part2]
ctagcgtggtca

SEQ ID NO: 46094 - DNA, 12 bp, Artificial Sequence
  synthetic [barcode part2]
taccagcggtca

SEQ ID NO: 46095 - DNA, 12 bp, Artificial Sequence
  synthetic [barcode part2]
actgcaccaata

SEQ ID NO: 46096 - DNA, 12 bp, Artificial Sequence
  synthetic [barcode part2]
ttgcgtgagcca

SEQ ID NO: 46097 - DNA, 12 bp, Artificial Sequence
  synthetic [barcode part2]
tgcggcttagtg

SEQ ID NO: 46098 - DNA, 12 bp, Artificial Sequence
  synthetic [barcode part2]
tactaacagcca

SEQ ID NO: 46099 - DNA, 12 bp, Artificial Sequence
  synthetic [barcode part2]
tagtggcgtgct

SEQ ID NO: 46100 - DNA, 12 bp, Artificial Sequence
  synthetic [barcode part2]
tgtatcaagcca

SEQ ID NO: 46101 - DNA, 12 bp, Artificial Sequence
  synthetic [barcode part2]
taatggctatgc

SEQ ID NO: 46102 - DNA, 12 bp, Artificial Sequence
  synthetic [barcode part2]
caagcgtaccgt

SEQ ID NO: 46103 - DNA, 12 bp, Artificial Sequence
  synthetic [barcode part2]
ttccagcatcac

SEQ ID NO: 46104 - DNA, 12 bp, Artificial Sequence
  synthetic [barcode part2]
ttggtatggcta

SEQ ID NO: 46105 - DNA, 12 bp, Artificial Sequence
  synthetic [barcode part2]
tagcggtgcact

SEQ ID NO: 46106 - DNA, 12 bp, Artificial Sequence
  synthetic [barcode part2]
tgagcacatcat

SEQ ID NO: 46107 - DNA, 12 bp, Artificial Sequence
  synthetic [barcode part2]
tgatgtatggct

SEQ ID NO: 46108 - DNA, 12 bp, Artificial Sequence
  synthetic [barcode part2]
tacgcgtagaga

SEQ ID NO: 46109 - DNA, 12 bp, Artificial Sequence
  synthetic [barcode part2]
taagccaacatc

SEQ ID NO: 46110 - DNA, 12 bp, Artificial Sequence
  synthetic [barcode part2]
ttggcgtccaga

SEQ ID NO: 46111 - DNA, 12 bp, Artificial Sequence
  synthetic [barcode part2]
caagctggtgct

SEQ ID NO: 46112 - DNA, 12 bp, Artificial Sequence
  synthetic [barcode part2]
atcaccgcgtga

SEQ ID NO: 46113 - DNA, 12 bp, Artificial Sequence
  synthetic [barcode part2]
tcagagacggta

SEQ ID NO: 46114 - DNA, 12 bp, Artificial Sequence
  synthetic [barcode part2]
tgtggctcagca

SEQ ID NO: 46115 - DNA, 12 bp, Artificial Sequence
  synthetic [barcode part2]
tgagccatacat

SEQ ID NO: 46116 - DNA, 12 bp, Artificial Sequence
  synthetic [barcode part2]
tacaactcagca

SEQ ID NO: 46117 - DNA, 12 bp, Artificial Sequence
  synthetic [barcode part2]
tatggaagcgtg

SEQ ID NO: 46118 - DNA, 12 bp, Artificial Sequence
  synthetic [barcode part2]
tgacgcagctgt

SEQ ID NO: 46119 - DNA, 12 bp, Artificial Sequence
  synthetic [barcode part2]
ttggcacagtta

SEQ ID NO: 46120 - DNA, 12 bp, Artificial Sequence
  synthetic [barcode part2]
aagcggttaacg

SEQ ID NO: 46121 - DNA, 12 bp, Artificial Sequence
  synthetic [barcode part2]
tgttgcgctcta

SEQ ID NO: 46122 - DNA, 12 bp, Artificial Sequence
  synthetic [barcode part2]
tctggcttcaac

SEQ ID NO: 46123 - DNA, 12 bp, Artificial Sequence
  synthetic [barcode part2]
tagtgtacagct

SEQ ID NO: 46124 - DNA, 12 bp, Artificial Sequence
  synthetic [barcode part2]
ttagctgctctg

SEQ ID NO: 46125 - DNA, 12 bp, Artificial Sequence
  synthetic [barcode part2]
tacgccaagcca

SEQ ID NO: 46126 - DNA, 12 bp, Artificial Sequence
  synthetic [barcode part2]
tactggcaatca

SEQ ID NO: 46127 - DNA, 12 bp, Artificial Sequence
  synthetic [barcode part2]
ttaacgcagccg

SEQ ID NO: 46128 - DNA, 12 bp, Artificial Sequence
  synthetic [barcode part2]
tcagaccataca

SEQ ID NO: 46129 - DNA, 12 bp, Artificial Sequence
  synthetic [barcode part2]
tcaacgcggtca

SEQ ID NO: 46130 - DNA, 12 bp, Artificial Sequence
  synthetic [barcode part2]
acaaccgctggt

SEQ ID NO: 46131 - DNA, 12 bp, Artificial Sequence
  synthetic [barcode part2]
ttgaatcacgca

SEQ ID NO: 46132 - DNA, 12 bp, Artificial Sequence
  synthetic [barcode part2]
tgtgcacttcca

SEQ ID NO: 46133 - DNA, 12 bp, Artificial Sequence
  synthetic [barcode part2]
ttacagcttccg

SEQ ID NO: 46134 - DNA, 12 bp, Artificial Sequence
  synthetic [barcode part2]
tattggcagccg

SEQ ID NO: 46135 - DNA, 12 bp, Artificial Sequence
  synthetic [barcode part2]
ttaagagcagcg

SEQ ID NO: 46136 - DNA, 12 bp, Artificial Sequence
  synthetic [barcode part2]
ttaagccacgcg

SEQ ID NO: 46137 - DNA, 12 bp, Artificial Sequence
  synthetic [barcode part2]
catctaacggta

SEQ ID NO: 46138 - DNA, 12 bp, Artificial Sequence
  synthetic [barcode part2]
ttgttgacgtga

SEQ ID NO: 46139 - DNA, 12 bp, Artificial Sequence
  synthetic [barcode part2]
ttgatgtgacca

SEQ ID NO: 46140 - DNA, 12 bp, Artificial Sequence
  synthetic [barcode part2]
ttagtatagccg

SEQ ID NO: 46141 - DNA, 12 bp, Artificial Sequence
  synthetic [barcode part2]
tctcaatgctgc

SEQ ID NO: 46142 - DNA, 12 bp, Artificial Sequence
  synthetic [barcode part2]
tagtggctgcgt

SEQ ID NO: 46143 - DNA, 12 bp, Artificial Sequence
  synthetic [barcode part2]
tcaatgtagcca

SEQ ID NO: 46144 - DNA, 12 bp, Artificial Sequence
  synthetic [barcode part2]
ttgagccataca

SEQ ID NO: 46145 - DNA, 12 bp, Artificial Sequence
  synthetic [barcode part2]
acggttaccagc

SEQ ID NO: 46146 - DNA, 12 bp, Artificial Sequence
  synthetic [barcode part2]
atccggtacgca

SEQ ID NO: 46147 - DNA, 12 bp, Artificial Sequence
  synthetic [barcode part2]
taccaatctgga

SEQ ID NO: 46148 - DNA, 12 bp, Artificial Sequence
  synthetic [barcode part2]
tgatatggctgt

SEQ ID NO: 46149 - DNA, 12 bp, Artificial Sequence
  synthetic [barcode part2]
ctccggtactat

SEQ ID NO: 46150 - DNA, 12 bp, Artificial Sequence
  synthetic [barcode part2]
aataccggaagc

SEQ ID NO: 46151 - DNA, 12 bp, Artificial Sequence
  synthetic [barcode part2]
actaccggcaca

SEQ ID NO: 46152 - DNA, 12 bp, Artificial Sequence
  synthetic [barcode part2]
tacgttactgga

SEQ ID NO: 46153 - DNA, 12 bp, Artificial Sequence
  synthetic [barcode part2]
tagacgccagct

SEQ ID NO: 46154 - DNA, 12 bp, Artificial Sequence
  synthetic [barcode part2]
tgtgtgctctca

SEQ ID NO: 46155 - DNA, 12 bp, Artificial Sequence
  synthetic [barcode part2]
tgctctcatgtg

SEQ ID NO: 46156 - DNA, 12 bp, Artificial Sequence
  synthetic [barcode part2]
tagactaacgct

SEQ ID NO: 46157 - DNA, 12 bp, Artificial Sequence
  synthetic [barcode part2]
tgagcgtgccat

SEQ ID NO: 46158 - DNA, 12 bp, Artificial Sequence
  synthetic [barcode part2]
ctacacggacca

SEQ ID NO: 46159 - DNA, 12 bp, Artificial Sequence
  synthetic [barcode part2]
tcacgcagatta

SEQ ID NO: 46160 - DNA, 12 bp, Artificial Sequence
  synthetic [barcode part2]
cataccggacca

SEQ ID NO: 46161 - DNA, 12 bp, Artificial Sequence
  synthetic [barcode part2]
tacagagcgtga

SEQ ID NO: 46162 - DNA, 12 bp, Artificial Sequence
  synthetic [barcode part2]
tggtggctacac

SEQ ID NO: 46163 - DNA, 12 bp, Artificial Sequence
  synthetic [barcode part2]
tcacgtggacca

SEQ ID NO: 46164 - DNA, 12 bp, Artificial Sequence
  synthetic [barcode part2]
tcatctctggca

SEQ ID NO: 46165 - DNA, 12 bp, Artificial Sequence
  synthetic [barcode part2]
tactgatggtca

SEQ ID NO: 46166 - DNA, 12 bp, Artificial Sequence
  synthetic [barcode part2]
ttggtgcaacta

SEQ ID NO: 46167 - DNA, 12 bp, Artificial Sequence
  synthetic [barcode part2]
tcagtatggtca

SEQ ID NO: 46168 - DNA, 12 bp, Artificial Sequence
  synthetic [barcode part2]
tcaagccatgta

SEQ ID NO: 46169 - DNA, 12 bp, Artificial Sequence
  synthetic [barcode part2]
tcagctggaaga

SEQ ID NO: 46170 - DNA, 12 bp, Artificial Sequence
  synthetic [barcode part2]
cgcggtctagta

SEQ ID NO: 46171 - DNA, 12 bp, Artificial Sequence
  synthetic [barcode part2]
tccacatgtgct

SEQ ID NO: 46172 - DNA, 12 bp, Artificial Sequence
  synthetic [barcode part2]
tgtattggacca

SEQ ID NO: 46173 - DNA, 12 bp, Artificial Sequence
  synthetic [barcode part2]
tgttagtccaga

SEQ ID NO: 46174 - DNA, 12 bp, Artificial Sequence
  synthetic [barcode part2]
ttctgatgctgc

SEQ ID NO: 46175 - DNA, 12 bp, Artificial Sequence
  synthetic [barcode part2]
taagctgcacgc

SEQ ID NO: 46176 - DNA, 12 bp, Artificial Sequence
  synthetic [barcode part2]
tgttggcggtca

SEQ ID NO: 46177 - DNA, 12 bp, Artificial Sequence
  synthetic [barcode part2]
ttggattgcgta

SEQ ID NO: 46178 - DNA, 12 bp, Artificial Sequence
  synthetic [barcode part2]
taccacgtctca

SEQ ID NO: 46179 - DNA, 12 bp, Artificial Sequence
  synthetic [barcode part2]
tactggcggcta

SEQ ID NO: 46180 - DNA, 12 bp, Artificial Sequence
  synthetic [barcode part2]
tagatacgctgt

SEQ ID NO: 46181 - DNA, 12 bp, Artificial Sequence
  synthetic [barcode part2]
taagcaccaatc

SEQ ID NO: 46182 - DNA, 12 bp, Artificial Sequence
  synthetic [barcode part2]
tgctcaatagtg

SEQ ID NO: 46183 - DNA, 12 bp, Artificial Sequence
  synthetic [barcode part2]
cgcactagacca

SEQ ID NO: 46184 - DNA, 12 bp, Artificial Sequence
  synthetic [barcode part2]
ttgagttgcaca

SEQ ID NO: 46185 - DNA, 12 bp, Artificial Sequence
  synthetic [barcode part2]
ctggaccatacg

SEQ ID NO: 46186 - DNA, 12 bp, Artificial Sequence
  synthetic [barcode part2]
tgcttagtggcg

SEQ ID NO: 46187 - DNA, 12 bp, Artificial Sequence
  synthetic [barcode part2]
ttaatacggctg

SEQ ID NO: 46188 - DNA, 12 bp, Artificial Sequence
  synthetic [barcode part2]
tgaatcagcact

SEQ ID NO: 46189 - DNA, 12 bp, Artificial Sequence
  synthetic [barcode part2]
tggtgtagccac

SEQ ID NO: 46190 - DNA, 12 bp, Artificial Sequence
  synthetic [barcode part2]
tcacgtgttaga

SEQ ID NO: 46191 - DNA, 12 bp, Artificial Sequence
  synthetic [barcode part2]
tgagtattggct

SEQ ID NO: 46192 - DNA, 12 bp, Artificial Sequence
  synthetic [barcode part2]
ttgcgtgccaga

SEQ ID NO: 46193 - DNA, 12 bp, Artificial Sequence
  synthetic [barcode part2]
tgatgatgtgct

SEQ ID NO: 46194 - DNA, 12 bp, Artificial Sequence
  synthetic [barcode part2]
tccatcagccat

SEQ ID NO: 46195 - DNA, 12 bp, Artificial Sequence
  synthetic [barcode part2]
ttgacatggtca

SEQ ID NO: 46196 - DNA, 12 bp, Artificial Sequence
  synthetic [barcode part2]
tgatggctgtat

SEQ ID NO: 46197 - DNA, 12 bp, Artificial Sequence
  synthetic [barcode part2]
tgatggcacgct

SEQ ID NO: 46198 - DNA, 12 bp, Artificial Sequence
  synthetic [barcode part2]
tgagtgccagct

SEQ ID NO: 46199 - DNA, 12 bp, Artificial Sequence
  synthetic [barcode part2]
tagcacgcagct

SEQ ID NO: 46200 - DNA, 12 bp, Artificial Sequence
  synthetic [barcode part2]
tacgctgagtta

SEQ ID NO: 46201 - DNA, 12 bp, Artificial Sequence
  synthetic [barcode part2]
cttatcacggtc

SEQ ID NO: 46202 - DNA, 12 bp, Artificial Sequence
  synthetic [barcode part2]
tccgttacagct

SEQ ID NO: 46203 - DNA, 12 bp, Artificial Sequence
  synthetic [barcode part2]
cggctctctaat

SEQ ID NO: 46204 - DNA, 12 bp, Artificial Sequence
  synthetic [barcode part2]
tccgctgtaact

SEQ ID NO: 46205 - DNA, 12 bp, Artificial Sequence
  synthetic [barcode part2]
tgttagtagcca

SEQ ID NO: 46206 - DNA, 12 bp, Artificial Sequence
  synthetic [barcode part2]
ccgtacactgga

SEQ ID NO: 46207 - DNA, 12 bp, Artificial Sequence
  synthetic [barcode part2]
cttggtcttagc

SEQ ID NO: 46208 - DNA, 12 bp, Artificial Sequence
  synthetic [barcode part2]
tcaagttgcgta

SEQ ID NO: 46209 - DNA, 12 bp, Artificial Sequence
  synthetic [barcode part2]
tggcttcaactc

SEQ ID NO: 46210 - DNA, 12 bp, Artificial Sequence
  synthetic [barcode part2]
agcagttgtatc

SEQ ID NO: 46211 - DNA, 12 bp, Artificial Sequence
  synthetic [barcode part2]
accgctgatacg

SEQ ID NO: 46212 - DNA, 12 bp, Artificial Sequence
  synthetic [barcode part2]
aagcataacgcg

SEQ ID NO: 46213 - DNA, 12 bp, Artificial Sequence
  synthetic [barcode part2]
tctgctggttac

SEQ ID NO: 46214 - DNA, 12 bp, Artificial Sequence
  synthetic [barcode part2]
caagcgttggct

SEQ ID NO: 46215 - DNA, 12 bp, Artificial Sequence
  synthetic [barcode part2]
tattaacggctg

SEQ ID NO: 46216 - DNA, 12 bp, Artificial Sequence
  synthetic [barcode part2]
atacagcttgac

SEQ ID NO: 46217 - DNA, 12 bp, Artificial Sequence
  synthetic [barcode part2]
atctagtgtgca

SEQ ID NO: 46218 - DNA, 12 bp, Artificial Sequence
  synthetic [barcode part2]
aacaatcacgct

SEQ ID NO: 46219 - DNA, 12 bp, Artificial Sequence
  synthetic [barcode part2]
cgtcagcaactg

SEQ ID NO: 46220 - DNA, 12 bp, Artificial Sequence
  synthetic [barcode part2]
aagccagaactg

SEQ ID NO: 46221 - DNA, 12 bp, Artificial Sequence
  synthetic [barcode part2]
agagcacatgtg

SEQ ID NO: 46222 - DNA, 12 bp, Artificial Sequence
  synthetic [barcode part2]
ctgagttgcgtg

SEQ ID NO: 46223 - DNA, 12 bp, Artificial Sequence
  synthetic [barcode part2]
tccattggctgt

SEQ ID NO: 46224 - DNA, 12 bp, Artificial Sequence
  synthetic [barcode part2]
cacatcaagccg

SEQ ID NO: 46225 - DNA, 12 bp, Artificial Sequence
  synthetic [barcode part2]
agcgtatagttc

SEQ ID NO: 46226 - DNA, 12 bp, Artificial Sequence
  synthetic [barcode part2]
tcttgtagcgtc

SEQ ID NO: 46227 - DNA, 12 bp, Artificial Sequence
  synthetic [barcode part2]
tacacgctctca

SEQ ID NO: 46228 - DNA, 12 bp, Artificial Sequence
  synthetic [barcode part2]
catgtgcagaga

SEQ ID NO: 46229 - DNA, 12 bp, Artificial Sequence
  synthetic [barcode part2]
tgacagctgcgt

SEQ ID NO: 46230 - DNA, 12 bp, Artificial Sequence
  synthetic [barcode part2]
aatctctgctgc

SEQ ID NO: 46231 - DNA, 12 bp, Artificial Sequence
  synthetic [barcode part2]
aatggcttacac

SEQ ID NO: 46232 - DNA, 12 bp, Artificial Sequence
  synthetic [barcode part2]
tccacgctgtat

SEQ ID NO: 46233 - DNA, 12 bp, Artificial Sequence
  synthetic [barcode part2]
cttaccgtgatc

SEQ ID NO: 46234 - DNA, 12 bp, Artificial Sequence
  synthetic [barcode part2]
ctgattgttccg

SEQ ID NO: 46235 - DNA, 12 bp, Artificial Sequence
  synthetic [barcode part2]
tatacgcttccg

SEQ ID NO: 46236 - DNA, 12 bp, Artificial Sequence
  synthetic [barcode part2]
ctaagagtggca

SEQ ID NO: 46237 - DNA, 12 bp, Artificial Sequence
  synthetic [barcode part2]
taacagcgcgtc

SEQ ID NO: 46238 - DNA, 12 bp, Artificial Sequence
  synthetic [barcode part2]
acagcgtagagt

SEQ ID NO: 46239 - DNA, 12 bp, Artificial Sequence
  synthetic [barcode part2]
cgctaacaatca

SEQ ID NO: 46240 - DNA, 12 bp, Artificial Sequence
  synthetic [barcode part2]
tacttgacggta

SEQ ID NO: 46241 - DNA, 12 bp, Artificial Sequence
  synthetic [barcode part2]
actgaccagaga

SEQ ID NO: 46242 - DNA, 12 bp, Artificial Sequence
  synthetic [barcode part2]
tagcaatgtgct

SEQ ID NO: 46243 - DNA, 12 bp, Artificial Sequence
  synthetic [barcode part2]
cgctctcataca

SEQ ID NO: 46244 - DNA, 12 bp, Artificial Sequence
  synthetic [barcode part2]
cgcttgatggca

SEQ ID NO: 46245 - DNA, 12 bp, Artificial Sequence
  synthetic [barcode part2]
ttactaagcacg

SEQ ID NO: 46246 - DNA, 12 bp, Artificial Sequence
  synthetic [barcode part2]
tcaacgcaacta

SEQ ID NO: 46247 - DNA, 12 bp, Artificial Sequence
  synthetic [barcode part2]
ttggaccatgta

SEQ ID NO: 46248 - DNA, 12 bp, Artificial Sequence
  synthetic [barcode part2]
ttccatagcgtc

SEQ ID NO: 46249 - DNA, 12 bp, Artificial Sequence
  synthetic [barcode part2]
aatggaagctgc

SEQ ID NO: 46250 - DNA, 12 bp, Artificial Sequence
  synthetic [barcode part2]
ctagattgtgca

SEQ ID NO: 46251 - DNA, 12 bp, Artificial Sequence
  synthetic [barcode part2]
cttgcgttacac

SEQ ID NO: 46252 - DNA, 12 bp, Artificial Sequence
  synthetic [barcode part2]
ctagtgcagcca

SEQ ID NO: 46253 - DNA, 12 bp, Artificial Sequence
  synthetic [barcode part2]
tgaacgctggct

SEQ ID NO: 46254 - DNA, 12 bp, Artificial Sequence
  synthetic [barcode part2]
ctctagtaccgt

SEQ ID NO: 46255 - DNA, 12 bp, Artificial Sequence
  synthetic [barcode part2]
catggtctaaca

SEQ ID NO: 46256 - DNA, 12 bp, Artificial Sequence
  synthetic [barcode part2]
agcattgctctc

SEQ ID NO: 46257 - DNA, 12 bp, Artificial Sequence
  synthetic [barcode part2]
tccactatggct

SEQ ID NO: 46258 - DNA, 12 bp, Artificial Sequence
  synthetic [barcode part2]
ctgacgcaactg

SEQ ID NO: 46259 - DNA, 12 bp, Artificial Sequence
  synthetic [barcode part2]
ccgcaatgaaga

SEQ ID NO: 46260 - DNA, 12 bp, Artificial Sequence
  synthetic [barcode part2]
acacgtgagagt

SEQ ID NO: 46261 - DNA, 12 bp, Artificial Sequence
  synthetic [barcode part2]
tgcttagcaatg

SEQ ID NO: 46262 - DNA, 12 bp, Artificial Sequence
  synthetic [barcode part2]
cggcttctcaat

SEQ ID NO: 46263 - DNA, 12 bp, Artificial Sequence
  synthetic [barcode part2]
agccaatagagc

SEQ ID NO: 46264 - DNA, 12 bp, Artificial Sequence
  synthetic [barcode part2]
attgctggcacg

SEQ ID NO: 46265 - DNA, 12 bp, Artificial Sequence
  synthetic [barcode part2]
tcacatactgga

SEQ ID NO: 46266 - DNA, 12 bp, Artificial Sequence
  synthetic [barcode part2]
tagcgtggctgt

SEQ ID NO: 46267 - DNA, 12 bp, Artificial Sequence
  synthetic [barcode part2]
atccgcatgata

SEQ ID NO: 46268 - DNA, 12 bp, Artificial Sequence
  synthetic [barcode part2]
tagtgcgtggct

SEQ ID NO: 46269 - DNA, 12 bp, Artificial Sequence
  synthetic [barcode part2]
ctgatacagttg

SEQ ID NO: 46270 - DNA, 12 bp, Artificial Sequence
  synthetic [barcode part2]
ccggtatccaga

SEQ ID NO: 46271 - DNA, 12 bp, Artificial Sequence
  synthetic [barcode part2]
tcattagcgtga

SEQ ID NO: 46272 - DNA, 12 bp, Artificial Sequence
  synthetic [barcode part2]
ccggtatgatta

SEQ ID NO: 46273 - DNA, 12 bp, Artificial Sequence
  synthetic [barcode part2]
atctggcgcgta

SEQ ID NO: 46274 - DNA, 12 bp, Artificial Sequence
  synthetic [barcode part2]
agtaactacgct

SEQ ID NO: 46275 - DNA, 12 bp, Artificial Sequence
  synthetic [barcode part2]
atatctccgcac

SEQ ID NO: 46276 - DNA, 12 bp, Artificial Sequence
  synthetic [barcode part2]
cagcgcatagtc

SEQ ID NO: 46277 - DNA, 12 bp, Artificial Sequence
  synthetic [barcode part2]
taccggtagcca

SEQ ID NO: 46278 - DNA, 12 bp, Artificial Sequence
  synthetic [barcode part2]
acgtagtaactc

SEQ ID NO: 46279 - DNA, 12 bp, Artificial Sequence
  synthetic [barcode part2]
ccacgtggattg

SEQ ID NO: 46280 - DNA, 12 bp, Artificial Sequence
  synthetic [barcode part2]
acttgcgtaaca

SEQ ID NO: 46281 - DNA, 12 bp, Artificial Sequence
  synthetic [barcode part2]
caatgatgcact

SEQ ID NO: 46282 - DNA, 12 bp, Artificial Sequence
  synthetic [barcode part2]
aattgtaccagc

SEQ ID NO: 46283 - DNA, 12 bp, Artificial Sequence
  synthetic [barcode part2]
ctactggtatga

SEQ ID NO: 46284 - DNA, 12 bp, Artificial Sequence
  synthetic [barcode part2]
agtaatctgcgt

SEQ ID NO: 46285 - DNA, 12 bp, Artificial Sequence
  synthetic [barcode part2]
agtaactcacgt

SEQ ID NO: 46286 - DNA, 12 bp, Artificial Sequence
  synthetic [barcode part2]
tggagttgaagc

SEQ ID NO: 46287 - DNA, 12 bp, Artificial Sequence
  synthetic [barcode part2]
agagaagctctg

SEQ ID NO: 46288 - DNA, 12 bp, Artificial Sequence
  synthetic [barcode part2]
ctcttgaccagt

SEQ ID NO: 46289 - DNA, 12 bp, Artificial Sequence
  synthetic [barcode part2]
actgagagacca

SEQ ID NO: 46290 - DNA, 12 bp, Artificial Sequence
  synthetic [barcode part2]
tgtgaccattga

SEQ ID NO: 46291 - DNA, 12 bp, Artificial Sequence
  synthetic [barcode part2]
tactgcgcttca

SEQ ID NO: 46292 - DNA, 12 bp, Artificial Sequence
  synthetic [barcode part2]
atacttccgtgc

SEQ ID NO: 46293 - DNA, 12 bp, Artificial Sequence
  synthetic [barcode part2]
acggagagtatc

SEQ ID NO: 46294 - DNA, 12 bp, Artificial Sequence
  synthetic [barcode part2]
acgttccgtatc

SEQ ID NO: 46295 - DNA, 12 bp, Artificial Sequence
  synthetic [barcode part2]
agcttgaacatc

SEQ ID NO: 46296 - DNA, 12 bp, Artificial Sequence
  synthetic [barcode part2]
taatgtagctgc

SEQ ID NO: 46297 - DNA, 12 bp, Artificial Sequence
  synthetic [barcode part2]
cgtatcaagttg

SEQ ID NO: 46298 - DNA, 12 bp, Artificial Sequence
  synthetic [barcode part2]
ccgctaagcaca

SEQ ID NO: 46299 - DNA, 12 bp, Artificial Sequence
  synthetic [barcode part2]
tgcttgatgatg

SEQ ID NO: 46300 - DNA, 12 bp, Artificial Sequence
  synthetic [barcode part2]
cagtatgtagtc

SEQ ID NO: 46301 - DNA, 12 bp, Artificial Sequence
  synthetic [barcode part2]
agtggctgtgct

SEQ ID NO: 46302 - DNA, 12 bp, Artificial Sequence
  synthetic [barcode part2]
tgaatgtgctgt

SEQ ID NO: 46303 - DNA, 12 bp, Artificial Sequence
  synthetic [barcode part2]
tcttggctagtc

SEQ ID NO: 46304 - DNA, 12 bp, Artificial Sequence
  synthetic [barcode part2]
ttgtgtactgga

SEQ ID NO: 46305 - DNA, 12 bp, Artificial Sequence
  synthetic [barcode part2]
tcatcaagtgca

SEQ ID NO: 46306 - DNA, 12 bp, Artificial Sequence
  synthetic [barcode part2]
cggtgtagctgt

SEQ ID NO: 46307 - DNA, 12 bp, Artificial Sequence
  synthetic [barcode part2]
tgtctaatggca

SEQ ID NO: 46308 - DNA, 12 bp, Artificial Sequence
  synthetic [barcode part2]
ttgcttctggca

SEQ ID NO: 46309 - DNA, 12 bp, Artificial Sequence
  synthetic [barcode part2]
ctatggcagaga

SEQ ID NO: 46310 - DNA, 12 bp, Artificial Sequence
  synthetic [barcode part2]
caagttacgtgt

SEQ ID NO: 46311 - DNA, 12 bp, Artificial Sequence
  synthetic [barcode part2]
acactggtggct

SEQ ID NO: 46312 - DNA, 12 bp, Artificial Sequence
  synthetic [barcode part2]
actataccagca

SEQ ID NO: 46313 - DNA, 12 bp, Artificial Sequence
  synthetic [barcode part2]
atagctgctggc

SEQ ID NO: 46314 - DNA, 12 bp, Artificial Sequence
  synthetic [barcode part2]
cagactaacatc

SEQ ID NO: 46315 - DNA, 12 bp, Artificial Sequence
  synthetic [barcode part2]
attgtattggcg

SEQ ID NO: 46316 - DNA, 12 bp, Artificial Sequence
  synthetic [barcode part2]
ctctcaactggt

SEQ ID NO: 46317 - DNA, 12 bp, Artificial Sequence
  synthetic [barcode part2]
tgtggcttgata

SEQ ID NO: 46318 - DNA, 12 bp, Artificial Sequence
  synthetic [barcode part2]
atatcaagctgc

SEQ ID NO: 46319 - DNA, 12 bp, Artificial Sequence
  synthetic [barcode part2]
ccgtgtaagcca

SEQ ID NO: 46320 - DNA, 12 bp, Artificial Sequence
  synthetic [barcode part2]
ctaaccgttcca

SEQ ID NO: 46321 - DNA, 12 bp, Artificial Sequence
  synthetic [barcode part2]
cagcacggttac

SEQ ID NO: 46322 - DNA, 12 bp, Artificial Sequence
  synthetic [barcode part2]
aacaacttgcgt

SEQ ID NO: 46323 - DNA, 12 bp, Artificial Sequence
  synthetic [barcode part2]
ctaacgcagtta

SEQ ID NO: 46324 - DNA, 12 bp, Artificial Sequence
  synthetic [barcode part2]
cgtattggattg

SEQ ID NO: 46325 - DNA, 12 bp, Artificial Sequence
  synthetic [barcode part2]
ttgttgagcgta

SEQ ID NO: 46326 - DNA, 12 bp, Artificial Sequence
  synthetic [barcode part2]
cagatcaatgtc

SEQ ID NO: 46327 - DNA, 12 bp, Artificial Sequence
  synthetic [barcode part2]
tgacacgtggct

SEQ ID NO: 46328 - DNA, 12 bp, Artificial Sequence
  synthetic [barcode part2]
cgtattgagccg

SEQ ID NO: 46329 - DNA, 12 bp, Artificial Sequence
  synthetic [barcode part2]
atggagagcact

SEQ ID NO: 46330 - DNA, 12 bp, Artificial Sequence
  synthetic [barcode part2]
cagattgcgtgc

SEQ ID NO: 46331 - DNA, 12 bp, Artificial Sequence
  synthetic [barcode part2]
acaacgctctct

SEQ ID NO: 46332 - DNA, 12 bp, Artificial Sequence
  synthetic [barcode part2]
tcaaccgctcta

SEQ ID NO: 46333 - DNA, 12 bp, Artificial Sequence
  synthetic [barcode part2]
agcagccacatc

SEQ ID NO: 46334 - DNA, 12 bp, Artificial Sequence
  synthetic [barcode part2]
aaccagctctct

SEQ ID NO: 46335 - DNA, 12 bp, Artificial Sequence
  synthetic [barcode part2]
tcaaccgtctca

SEQ ID NO: 46336 - DNA, 12 bp, Artificial Sequence
  synthetic [barcode part2]
agcaatccgcac

SEQ ID NO: 46337 - DNA, 12 bp, Artificial Sequence
  synthetic [barcode part2]
catcttccgtga

SEQ ID NO: 46338 - DNA, 12 bp, Artificial Sequence
  synthetic [barcode part2]
tgtgattgctga

SEQ ID NO: 46339 - DNA, 12 bp, Artificial Sequence
  synthetic [barcode part2]
cagcttcttagc

SEQ ID NO: 46340 - DNA, 12 bp, Artificial Sequence
  synthetic [barcode part2]
ccgttgaacgca

SEQ ID NO: 46341 - DNA, 12 bp, Artificial Sequence
  synthetic [barcode part2]
tcaagccgcaca

SEQ ID NO: 46342 - DNA, 12 bp, Artificial Sequence
  synthetic [barcode part2]
acgtcaagccac

SEQ ID NO: 46343 - DNA, 12 bp, Artificial Sequence
  synthetic [barcode part2]
tgtgctgagcca

SEQ ID NO: 46344 - DNA, 12 bp, Artificial Sequence
  synthetic [barcode part2]
tactctcacgca

SEQ ID NO: 46345 - DNA, 12 bp, Artificial Sequence
  synthetic [barcode part2]
cggactatacat

SEQ ID NO: 46346 - DNA, 12 bp, Artificial Sequence
  synthetic [barcode part2]
cggatcaacgct

SEQ ID NO: 46347 - DNA, 12 bp, Artificial Sequence
  synthetic [barcode part2]
cggcgcagttat

SEQ ID NO: 46348 - DNA, 12 bp, Artificial Sequence
  synthetic [barcode part2]
acggagatgtac

SEQ ID NO: 46349 - DNA, 12 bp, Artificial Sequence
  synthetic [barcode part2]
agctgcggattc

SEQ ID NO: 46350 - DNA, 12 bp, Artificial Sequence
  synthetic [barcode part2]
acttacacagca

SEQ ID NO: 46351 - DNA, 12 bp, Artificial Sequence
  synthetic [barcode part2]
ctgatgtgattg

SEQ ID NO: 46352 - DNA, 12 bp, Artificial Sequence
  synthetic [barcode part2]
tctgttagctgc

SEQ ID NO: 46353 - DNA, 12 bp, Artificial Sequence
  synthetic [barcode part2]
ctatatgctgga

SEQ ID NO: 46354 - DNA, 12 bp, Artificial Sequence
  synthetic [barcode part2]
acgtaactcaac

SEQ ID NO: 46355 - DNA, 12 bp, Artificial Sequence
  synthetic [barcode part2]
cacttagcggtg

SEQ ID NO: 46356 - DNA, 12 bp, Artificial Sequence
  synthetic [barcode part2]
agacgcaatgtg

SEQ ID NO: 46357 - DNA, 12 bp, Artificial Sequence
  synthetic [barcode part2]
actctctggtca

SEQ ID NO: 46358 - DNA, 12 bp, Artificial Sequence
  synthetic [barcode part2]
tatccagcaatg

SEQ ID NO: 46359 - DNA, 12 bp, Artificial Sequence
  synthetic [barcode part2]
actggtctctca

SEQ ID NO: 46360 - DNA, 12 bp, Artificial Sequence
  synthetic [barcode part2]
ccggaccacata

SEQ ID NO: 46361 - DNA, 12 bp, Artificial Sequence
  synthetic [barcode part2]
agtggaatggct

SEQ ID NO: 46362 - DNA, 12 bp, Artificial Sequence
  synthetic [barcode part2]
atctgatgcaca

SEQ ID NO: 46363 - DNA, 12 bp, Artificial Sequence
  synthetic [barcode part2]
ccatacaagccg

SEQ ID NO: 46364 - DNA, 12 bp, Artificial Sequence
  synthetic [barcode part2]
ctaccagacata

SEQ ID NO: 46365 - DNA, 12 bp, Artificial Sequence
  synthetic [barcode part2]
ccaacataactg

SEQ ID NO: 46366 - DNA, 12 bp, Artificial Sequence
  synthetic [barcode part2]
agtatgtccagt

SEQ ID NO: 46367 - DNA, 12 bp, Artificial Sequence
  synthetic [barcode part2]
cactaacagttg

SEQ ID NO: 46368 - DNA, 12 bp, Artificial Sequence
  synthetic [barcode part2]
ccgtgcgttaga

SEQ ID NO: 46369 - DNA, 12 bp, Artificial Sequence
  synthetic [barcode part2]
taccgtgttcca

SEQ ID NO: 46370 - DNA, 12 bp, Artificial Sequence
  synthetic [barcode part2]
ttgcgcattaga

SEQ ID NO: 46371 - DNA, 12 bp, Artificial Sequence
  synthetic [barcode part2]
cggtggctatgt

SEQ ID NO: 46372 - DNA, 12 bp, Artificial Sequence
  synthetic [barcode part2]
accacgctgatg

SEQ ID NO: 46373 - DNA, 12 bp, Artificial Sequence
  synthetic [barcode part2]
tctgctgcaatc

SEQ ID NO: 46374 - DNA, 12 bp, Artificial Sequence
  synthetic [barcode part2]
agccatattgac

SEQ ID NO: 46375 - DNA, 12 bp, Artificial Sequence
  synthetic [barcode part2]
aatgctgctctc

SEQ ID NO: 46376 - DNA, 12 bp, Artificial Sequence
  synthetic [barcode part2]
agacaatcagcg

SEQ ID NO: 46377 - DNA, 12 bp, Artificial Sequence
  synthetic [barcode part2]
cgccaatagcca

SEQ ID NO: 46378 - DNA, 12 bp, Artificial Sequence
  synthetic [barcode part2]
cttgtgccatac

SEQ ID NO: 46379 - DNA, 12 bp, Artificial Sequence
  synthetic [barcode part2]
ctagccactcta

SEQ ID NO: 46380 - DNA, 12 bp, Artificial Sequence
  synthetic [barcode part2]
ttgctaagtgca

SEQ ID NO: 46381 - DNA, 12 bp, Artificial Sequence
  synthetic [barcode part2]
agctctcattgc

SEQ ID NO: 46382 - DNA, 12 bp, Artificial Sequence
  synthetic [barcode part2]
ccatgatctctg

SEQ ID NO: 46383 - DNA, 12 bp, Artificial Sequence
  synthetic [barcode part2]
tgaagccggaat

SEQ ID NO: 46384 - DNA, 12 bp, Artificial Sequence
  synthetic [barcode part2]
tagtacagctgt

SEQ ID NO: 46385 - DNA, 12 bp, Artificial Sequence
  synthetic [barcode part2]
cttgtatcacgc

SEQ ID NO: 46386 - DNA, 12 bp, Artificial Sequence
  synthetic [barcode part2]
aacgccagaagt

SEQ ID NO: 46387 - DNA, 12 bp, Artificial Sequence
  synthetic [barcode part2]
attattggcgtg

SEQ ID NO: 46388 - DNA, 12 bp, Artificial Sequence
  synthetic [barcode part2]
agcgcgtctaac

SEQ ID NO: 46389 - DNA, 12 bp, Artificial Sequence
  synthetic [barcode part2]
ctgttagatacg

SEQ ID NO: 46390 - DNA, 12 bp, Artificial Sequence
  synthetic [barcode part2]
tcatatgccaga

SEQ ID NO: 46391 - DNA, 12 bp, Artificial Sequence
  synthetic [barcode part2]
aacacgcaatct

SEQ ID NO: 46392 - DNA, 12 bp, Artificial Sequence
  synthetic [barcode part2]
tgaactagtgct

SEQ ID NO: 46393 - DNA, 12 bp, Artificial Sequence
  synthetic [barcode part2]
acgccagcaatc

SEQ ID NO: 46394 - DNA, 12 bp, Artificial Sequence
  synthetic [barcode part2]
atccagcatgta

SEQ ID NO: 46395 - DNA, 12 bp, Artificial Sequence
  synthetic [barcode part2]
aatccagtgtac

SEQ ID NO: 46396 - DNA, 12 bp, Artificial Sequence
  synthetic [barcode part2]
atatgatccagc

SEQ ID NO: 46397 - DNA, 12 bp, Artificial Sequence
  synthetic [barcode part2]
cagtgattgcgc

SEQ ID NO: 46398 - DNA, 12 bp, Artificial Sequence
  synthetic [barcode part2]
tacatcagacca

SEQ ID NO: 46399 - DNA, 12 bp, Artificial Sequence
  synthetic [barcode part2]
agcgttaagagc

SEQ ID NO: 46400 - DNA, 12 bp, Artificial Sequence
  synthetic [barcode part2]
cgcaatccggta

SEQ ID NO: 46401 - DNA, 12 bp, Artificial Sequence
  synthetic [barcode part2]
attacgctggcg

SEQ ID NO: 46402 - DNA, 12 bp, Artificial Sequence
  synthetic [barcode part2]
taagaagccagc

SEQ ID NO: 46403 - DNA, 12 bp, Artificial Sequence
  synthetic [barcode part2]
ctaagttacgca

SEQ ID NO: 46404 - DNA, 12 bp, Artificial Sequence
  synthetic [barcode part2]
agctaacggaac

SEQ ID NO: 46405 - DNA, 12 bp, Artificial Sequence
  synthetic [barcode part2]
tgtgctgccaga

SEQ ID NO: 46406 - DNA, 12 bp, Artificial Sequence
  synthetic [barcode part2]
caacgcacagct

SEQ ID NO: 46407 - DNA, 12 bp, Artificial Sequence
  synthetic [barcode part2]
tagcagccacgt

SEQ ID NO: 46408 - DNA, 12 bp, Artificial Sequence
  synthetic [barcode part2]
cgctatgcttca

SEQ ID NO: 46409 - DNA, 12 bp, Artificial Sequence
  synthetic [barcode part2]
ttagagacagcg

SEQ ID NO: 46410 - DNA, 12 bp, Artificial Sequence
  synthetic [barcode part2]
cggcaatgcact

SEQ ID NO: 46411 - DNA, 12 bp, Artificial Sequence
  synthetic [barcode part2]
tctactagccac

SEQ ID NO: 46412 - DNA, 12 bp, Artificial Sequence
  synthetic [barcode part2]
tagccagcttct

SEQ ID NO: 46413 - DNA, 12 bp, Artificial Sequence
  synthetic [barcode part2]
ctatgtagacca

SEQ ID NO: 46414 - DNA, 12 bp, Artificial Sequence
  synthetic [barcode part2]
tcaagagcggta

SEQ ID NO: 46415 - DNA, 12 bp, Artificial Sequence
  synthetic [barcode part2]
ttgacgcggcta

SEQ ID NO: 46416 - DNA, 12 bp, Artificial Sequence
  synthetic [barcode part2]
tgatacagccat

SEQ ID NO: 46417 - DNA, 12 bp, Artificial Sequence
  synthetic [barcode part2]
actgccaacata

SEQ ID NO: 46418 - DNA, 12 bp, Artificial Sequence
  synthetic [barcode part2]
tgacagccatat

SEQ ID NO: 46419 - DNA, 12 bp, Artificial Sequence
  synthetic [barcode part2]
agtggcttgcgt

SEQ ID NO: 46420 - DNA, 12 bp, Artificial Sequence
  synthetic [barcode part2]
aacgctggagat

SEQ ID NO: 46421 - DNA, 12 bp, Artificial Sequence
  synthetic [barcode part2]
cggactacgtgt

SEQ ID NO: 46422 - DNA, 12 bp, Artificial Sequence
  synthetic [barcode part2]
ttgaactgtgca

SEQ ID NO: 46423 - DNA, 12 bp, Artificial Sequence
  synthetic [barcode part2]
acggattgttac

SEQ ID NO: 46424 - DNA, 12 bp, Artificial Sequence
  synthetic [barcode part2]
cagtaacgcgtc

SEQ ID NO: 46425 - DNA, 12 bp, Artificial Sequence
  synthetic [barcode part2]
cgcactaagtta

SEQ ID NO: 46426 - DNA, 12 bp, Artificial Sequence
  synthetic [barcode part2]
cggcagcatact

SEQ ID NO: 46427 - DNA, 12 bp, Artificial Sequence
  synthetic [barcode part2]
caatggcatact

SEQ ID NO: 46428 - DNA, 12 bp, Artificial Sequence
  synthetic [barcode part2]
cgcgtatagaga

SEQ ID NO: 46429 - DNA, 12 bp, Artificial Sequence
  synthetic [barcode part2]
agtggctcatat

SEQ ID NO: 46430 - DNA, 12 bp, Artificial Sequence
  synthetic [barcode part2]
tgttcaacagca

SEQ ID NO: 46431 - DNA, 12 bp, Artificial Sequence
  synthetic [barcode part2]
ttagcgtggctg

SEQ ID NO: 46432 - DNA, 12 bp, Artificial Sequence
  synthetic [barcode part2]
tgaagagctggt

SEQ ID NO: 46433 - DNA, 12 bp, Artificial Sequence
  synthetic [barcode part2]
caacagcgcact

SEQ ID NO: 46434 - DNA, 12 bp, Artificial Sequence
  synthetic [barcode part2]
ttggagagctga

SEQ ID NO: 46435 - DNA, 12 bp, Artificial Sequence
  synthetic [barcode part2]
tgagccaatact

SEQ ID NO: 46436 - DNA, 12 bp, Artificial Sequence
  synthetic [barcode part2]
ttggcacttaga

SEQ ID NO: 46437 - DNA, 12 bp, Artificial Sequence
  synthetic [barcode part2]
agcatgttcaac

SEQ ID NO: 46438 - DNA, 12 bp, Artificial Sequence
  synthetic [barcode part2]
cgctagtaacta

SEQ ID NO: 46439 - DNA, 12 bp, Artificial Sequence
  synthetic [barcode part2]
tctgtgctatgc

SEQ ID NO: 46440 - DNA, 12 bp, Artificial Sequence
  synthetic [barcode part2]
acgttgagttac

SEQ ID NO: 46441 - DNA, 12 bp, Artificial Sequence
  synthetic [barcode part2]
tgcttccacatg

SEQ ID NO: 46442 - DNA, 12 bp, Artificial Sequence
  synthetic [barcode part2]
cacttagtaacg

SEQ ID NO: 46443 - DNA, 12 bp, Artificial Sequence
  synthetic [barcode part2]
atcttccagcca

SEQ ID NO: 46444 - DNA, 12 bp, Artificial Sequence
  synthetic [barcode part2]
tgagttaacgct

SEQ ID NO: 46445 - DNA, 12 bp, Artificial Sequence
  synthetic [barcode part2]
aatccagcacgc

SEQ ID NO: 46446 - DNA, 12 bp, Artificial Sequence
  synthetic [barcode part2]
ctaacgcttaga

SEQ ID NO: 46447 - DNA, 12 bp, Artificial Sequence
  synthetic [barcode part2]
ttaagccgtatg

SEQ ID NO: 46448 - DNA, 12 bp, Artificial Sequence
  synthetic [barcode part2]
taagcgtactac

SEQ ID NO: 46449 - DNA, 12 bp, Artificial Sequence
  synthetic [barcode part2]
aagtggccaatg

SEQ ID NO: 46450 - DNA, 12 bp, Artificial Sequence
  synthetic [barcode part2]
tgctgatagccg

SEQ ID NO: 46451 - DNA, 12 bp, Artificial Sequence
  synthetic [barcode part2]
cggtaacgtgct

SEQ ID NO: 46452 - DNA, 12 bp, Artificial Sequence
  synthetic [barcode part2]
tcagcgtgacca

SEQ ID NO: 46453 - DNA, 12 bp, Artificial Sequence
  synthetic [barcode part2]
cgcttgacaata

SEQ ID NO: 46454 - DNA, 12 bp, Artificial Sequence
  synthetic [barcode part2]
tcagcacagcca

SEQ ID NO: 46455 - DNA, 12 bp, Artificial Sequence
  synthetic [barcode part2]
acgttagactac

SEQ ID NO: 46456 - DNA, 12 bp, Artificial Sequence
  synthetic [barcode part2]
ctctgcgtatgt

SEQ ID NO: 46457 - DNA, 12 bp, Artificial Sequence
  synthetic [barcode part2]
cgtccagtaacg

SEQ ID NO: 46458 - DNA, 12 bp, Artificial Sequence
  synthetic [barcode part2]
cacttgatagtg

SEQ ID NO: 46459 - DNA, 12 bp, Artificial Sequence
  synthetic [barcode part2]
ataatcactggc

SEQ ID NO: 46460 - DNA, 12 bp, Artificial Sequence
  synthetic [barcode part2]
tacggcttggca

SEQ ID NO: 46461 - DNA, 12 bp, Artificial Sequence
  synthetic [barcode part2]
tgtatcaccaga

SEQ ID NO: 46462 - DNA, 12 bp, Artificial Sequence
  synthetic [barcode part2]
acaattgccagt

SEQ ID NO: 46463 - DNA, 12 bp, Artificial Sequence
  synthetic [barcode part2]
ttgtacaagcca

SEQ ID NO: 46464 - DNA, 12 bp, Artificial Sequence
  synthetic [barcode part2]
actcacggctga

SEQ ID NO: 46465 - DNA, 12 bp, Artificial Sequence
  synthetic [barcode part2]
aatgcacaactc

SEQ ID NO: 46466 - DNA, 12 bp, Artificial Sequence
  synthetic [barcode part2]
aatacgcttgac

SEQ ID NO: 46467 - DNA, 12 bp, Artificial Sequence
  synthetic [barcode part2]
cgtgtatctctg

SEQ ID NO: 46468 - DNA, 12 bp, Artificial Sequence
  synthetic [barcode part2]
caatatgcagct

SEQ ID NO: 46469 - DNA, 12 bp, Artificial Sequence
  synthetic [barcode part2]
tagtgatacgct

SEQ ID NO: 46470 - DNA, 12 bp, Artificial Sequence
  synthetic [barcode part2]
aagcgtgatgtg

SEQ ID NO: 46471 - DNA, 12 bp, Artificial Sequence
  synthetic [barcode part2]
cacagagatgtg

SEQ ID NO: 46472 - DNA, 12 bp, Artificial Sequence
  synthetic [barcode part2]
cggcataattgt

SEQ ID NO: 46473 - DNA, 12 bp, Artificial Sequence
  synthetic [barcode part2]
tcactggacata

SEQ ID NO: 46474 - DNA, 12 bp, Artificial Sequence
  synthetic [barcode part2]
agcttagtgtac

SEQ ID NO: 46475 - DNA, 12 bp, Artificial Sequence
  synthetic [barcode part2]
tcatggctctca

SEQ ID NO: 46476 - DNA, 12 bp, Artificial Sequence
  synthetic [barcode part2]
catccagcagca

SEQ ID NO: 46477 - DNA, 12 bp, Artificial Sequence
  synthetic [barcode part2]
ccgttgagtata

SEQ ID NO: 46478 - DNA, 12 bp, Artificial Sequence
  synthetic [barcode part2]
ctcatgtgtgct

SEQ ID NO: 46479 - DNA, 12 bp, Artificial Sequence
  synthetic [barcode part2]
tggttgaagagc

SEQ ID NO: 46480 - DNA, 12 bp, Artificial Sequence
  synthetic [barcode part2]
cactgatggctg

SEQ ID NO: 46481 - DNA, 12 bp, Artificial Sequence
  synthetic [barcode part2]
agccataccagc

SEQ ID NO: 46482 - DNA, 12 bp, Artificial Sequence
  synthetic [barcode part2]
atggtgctctct

SEQ ID NO: 46483 - DNA, 12 bp, Artificial Sequence
  synthetic [barcode part2]
ataaccgttagc

SEQ ID NO: 46484 - DNA, 12 bp, Artificial Sequence
  synthetic [barcode part2]
aacgctgagagt

SEQ ID NO: 46485 - DNA, 12 bp, Artificial Sequence
  synthetic [barcode part2]
cttggtcagttc

SEQ ID NO: 46486 - DNA, 12 bp, Artificial Sequence
  synthetic [barcode part2]
ccgctggataca

SEQ ID NO: 46487 - DNA, 12 bp, Artificial Sequence
  synthetic [barcode part2]
ccagattgcgtg

SEQ ID NO: 46488 - DNA, 12 bp, Artificial Sequence
  synthetic [barcode part2]
ccgttagacata

SEQ ID NO: 46489 - DNA, 12 bp, Artificial Sequence
  synthetic [barcode part2]
cgcactattaga

SEQ ID NO: 46490 - DNA, 12 bp, Artificial Sequence
  synthetic [barcode part2]
cacttccatgtg

SEQ ID NO: 46491 - DNA, 12 bp, Artificial Sequence
  synthetic [barcode part2]
agtccagtatgt

SEQ ID NO: 46492 - DNA, 12 bp, Artificial Sequence
  synthetic [barcode part2]
tcacttccagca

SEQ ID NO: 46493 - DNA, 12 bp, Artificial Sequence
  synthetic [barcode part2]
acatgcgcttct

SEQ ID NO: 46494 - DNA, 12 bp, Artificial Sequence
  synthetic [barcode part2]
tacgctggacca

SEQ ID NO: 46495 - DNA, 12 bp, Artificial Sequence
  synthetic [barcode part2]
ccaagccatacg

SEQ ID NO: 46496 - DNA, 12 bp, Artificial Sequence
  synthetic [barcode part2]
cggataccagct

SEQ ID NO: 46497 - DNA, 12 bp, Artificial Sequence
  synthetic [barcode part2]
caacacgtaact

SEQ ID NO: 46498 - DNA, 12 bp, Artificial Sequence
  synthetic [barcode part2]
agagttacagcg

SEQ ID NO: 46499 - DNA, 12 bp, Artificial Sequence
  synthetic [barcode part2]
aatcagcagagc

SEQ ID NO: 46500 - DNA, 12 bp, Artificial Sequence
  synthetic [barcode part2]
agtgattgcact

SEQ ID NO: 46501 - DNA, 12 bp, Artificial Sequence
  synthetic [barcode part2]
tgtagccgctga

SEQ ID NO: 46502 - DNA, 12 bp, Artificial Sequence
  synthetic [barcode part2]
ctcatacacgct

SEQ ID NO: 46503 - DNA, 12 bp, Artificial Sequence
  synthetic [barcode part2]
tcattgagcaca

SEQ ID NO: 46504 - DNA, 12 bp, Artificial Sequence
  synthetic [barcode part2]
agcaatcatgtc

SEQ ID NO: 46505 - DNA, 12 bp, Artificial Sequence
  synthetic [barcode part2]
aattcaagcgtc

SEQ ID NO: 46506 - DNA, 12 bp, Artificial Sequence
  synthetic [barcode part2]
agtggtcacgct

SEQ ID NO: 46507 - DNA, 12 bp, Artificial Sequence
  synthetic [barcode part2]
ctgcttctgatg

SEQ ID NO: 46508 - DNA, 12 bp, Artificial Sequence
  synthetic [barcode part2]
tcaatgtccaga

SEQ ID NO: 46509 - DNA, 12 bp, Artificial Sequence
  synthetic [barcode part2]
cgctgatgacca

SEQ ID NO: 46510 - DNA, 12 bp, Artificial Sequence
  synthetic [barcode part2]
cagtacaattgc

SEQ ID NO: 46511 - DNA, 12 bp, Artificial Sequence
  synthetic [barcode part2]
cgttaacagccg

SEQ ID NO: 46512 - DNA, 12 bp, Artificial Sequence
  synthetic [barcode part2]
cgccatagaaga

SEQ ID NO: 46513 - DNA, 12 bp, Artificial Sequence
  synthetic [barcode part2]
ctcacatgcact

SEQ ID NO: 46514 - DNA, 12 bp, Artificial Sequence
  synthetic [barcode part2]
ccaagttgcacg

SEQ ID NO: 46515 - DNA, 12 bp, Artificial Sequence
  synthetic [barcode part2]
cggagagttagt

SEQ ID NO: 46516 - DNA, 12 bp, Artificial Sequence
  synthetic [barcode part2]
agccgcatcaac

SEQ ID NO: 46517 - DNA, 12 bp, Artificial Sequence
  synthetic [barcode part2]
caatacatggct

SEQ ID NO: 46518 - DNA, 12 bp, Artificial Sequence
  synthetic [barcode part2]
ttggcgtgatta

SEQ ID NO: 46519 - DNA, 12 bp, Artificial Sequence
  synthetic [barcode part2]
tgctggcagttg

SEQ ID NO: 46520 - DNA, 12 bp, Artificial Sequence
  synthetic [barcode part2]
agacatagtgcg

SEQ ID NO: 46521 - DNA, 12 bp, Artificial Sequence
  synthetic [barcode part2]
acagagacgtgt

SEQ ID NO: 46522 - DNA, 12 bp, Artificial Sequence
  synthetic [barcode part2]
acgctggattgc

SEQ ID NO: 46523 - DNA, 12 bp, Artificial Sequence
  synthetic [barcode part2]
acttggcgcaca

SEQ ID NO: 46524 - DNA, 12 bp, Artificial Sequence
  synthetic [barcode part2]
cggcttcaatct

SEQ ID NO: 46525 - DNA, 12 bp, Artificial Sequence
  synthetic [barcode part2]
ccggagatgata

SEQ ID NO: 46526 - DNA, 12 bp, Artificial Sequence
  synthetic [barcode part2]
atggattgctgt

SEQ ID NO: 46527 - DNA, 12 bp, Artificial Sequence
  synthetic [barcode part2]
acacgtggagat

SEQ ID NO: 46528 - DNA, 12 bp, Artificial Sequence
  synthetic [barcode part2]
ctacggttctca

SEQ ID NO: 46529 - DNA, 12 bp, Artificial Sequence
  synthetic [barcode part2]
atactggatcac

SEQ ID NO: 46530 - DNA, 12 bp, Artificial Sequence
  synthetic [barcode part2]
ccactcttgatg

SEQ ID NO: 46531 - DNA, 12 bp, Artificial Sequence
  synthetic [barcode part2]
cttgattggctc

SEQ ID NO: 46532 - DNA, 12 bp, Artificial Sequence
  synthetic [barcode part2]
ttggaccgcaca

SEQ ID NO: 46533 - DNA, 12 bp, Artificial Sequence
  synthetic [barcode part2]
acagaccgctgt

SEQ ID NO: 46534 - DNA, 12 bp, Artificial Sequence
  synthetic [barcode part2]
tacgccaccaga

SEQ ID NO: 46535 - DNA, 12 bp, Artificial Sequence
  synthetic [barcode part2]
tacttccgcgta

SEQ ID NO: 46536 - DNA, 12 bp, Artificial Sequence
  synthetic [barcode part2]
ctagccatctca

SEQ ID NO: 46537 - DNA, 12 bp, Artificial Sequence
  synthetic [barcode part2]
cagtggctgtac

SEQ ID NO: 46538 - DNA, 12 bp, Artificial Sequence
  synthetic [barcode part2]
tccgctgattgt

SEQ ID NO: 46539 - DNA, 12 bp, Artificial Sequence
  synthetic [barcode part2]
atctgcgtagta

SEQ ID NO: 46540 - DNA, 12 bp, Artificial Sequence
  synthetic [barcode part2]
atgctaatggct

SEQ ID NO: 46541 - DNA, 12 bp, Artificial Sequence
  synthetic [barcode part2]
actatgttggca

SEQ ID NO: 46542 - DNA, 12 bp, Artificial Sequence
  synthetic [barcode part2]
taccggtgatta

SEQ ID NO: 46543 - DNA, 12 bp, Artificial Sequence
  synthetic [barcode part2]
tgcactaagccg

SEQ ID NO: 46544 - DNA, 12 bp, Artificial Sequence
  synthetic [barcode part2]
aatggctgcgtc

SEQ ID NO: 46545 - DNA, 12 bp, Artificial Sequence
  synthetic [barcode part2]
atcacatgctga

SEQ ID NO: 46546 - DNA, 12 bp, Artificial Sequence
  synthetic [barcode part2]
agaacatgtgcg

SEQ ID NO: 46547 - DNA, 12 bp, Artificial Sequence
  synthetic [barcode part2]
tacggtccagca

SEQ ID NO: 46548 - DNA, 12 bp, Artificial Sequence
  synthetic [barcode part2]
tcagtgcaatca

SEQ ID NO: 46549 - DNA, 12 bp, Artificial Sequence
  synthetic [barcode part2]
cagcaattgtac

SEQ ID NO: 46550 - DNA, 12 bp, Artificial Sequence
  synthetic [barcode part2]
tgagctgtatgt

SEQ ID NO: 46551 - DNA, 12 bp, Artificial Sequence
  synthetic [barcode part2]
tgtctctgtgca

SEQ ID NO: 46552 - DNA, 12 bp, Artificial Sequence
  synthetic [barcode part2]
cttatcagccac

SEQ ID NO: 46553 - DNA, 12 bp, Artificial Sequence
  synthetic [barcode part2]
taacagccgtgc

SEQ ID NO: 46554 - DNA, 12 bp, Artificial Sequence
  synthetic [barcode part2]
atagcacggaac

SEQ ID NO: 46555 - DNA, 12 bp, Artificial Sequence
  synthetic [barcode part2]
agacttcttccg

SEQ ID NO: 46556 - DNA, 12 bp, Artificial Sequence
  synthetic [barcode part2]
cagcataactac

SEQ ID NO: 46557 - DNA, 12 bp, Artificial Sequence
  synthetic [barcode part2]
cataccgttaga

SEQ ID NO: 46558 - DNA, 12 bp, Artificial Sequence
  synthetic [barcode part2]
cgcaatcattga

SEQ ID NO: 46559 - DNA, 12 bp, Artificial Sequence
  synthetic [barcode part2]
ttgtctccagca

SEQ ID NO: 46560 - DNA, 12 bp, Artificial Sequence
  synthetic [barcode part2]
acaagttgctgt

SEQ ID NO: 46561 - DNA, 12 bp, Artificial Sequence
  synthetic [barcode part2]
tgtaatccagca

SEQ ID NO: 46562 - DNA, 12 bp, Artificial Sequence
  synthetic [barcode part2]
ttcacgctatgc

SEQ ID NO: 46563 - DNA, 12 bp, Artificial Sequence
  synthetic [barcode part2]
aacttagcgcat

SEQ ID NO: 46564 - DNA, 12 bp, Artificial Sequence
  synthetic [barcode part2]
cacaatccagcg

SEQ ID NO: 46565 - DNA, 12 bp, Artificial Sequence
  synthetic [barcode part2]
ccagaagtaacg

SEQ ID NO: 46566 - DNA, 12 bp, Artificial Sequence
  synthetic [barcode part2]
attcatacagcg

SEQ ID NO: 46567 - DNA, 12 bp, Artificial Sequence
  synthetic [barcode part2]
atggctgccagt

SEQ ID NO: 46568 - DNA, 12 bp, Artificial Sequence
  synthetic [barcode part2]
tggctcttcaac

SEQ ID NO: 46569 - DNA, 12 bp, Artificial Sequence
  synthetic [barcode part2]
acgctaatagtc

SEQ ID NO: 46570 - DNA, 12 bp, Artificial Sequence
  synthetic [barcode part2]
agatacagcgtg

SEQ ID NO: 46571 - DNA, 12 bp, Artificial Sequence
  synthetic [barcode part2]
caagccaacgct

SEQ ID NO: 46572 - DNA, 12 bp, Artificial Sequence
  synthetic [barcode part2]
acaacgcggaat

SEQ ID NO: 46573 - DNA, 12 bp, Artificial Sequence
  synthetic [barcode part2]
caagtgcgctgt

SEQ ID NO: 46574 - DNA, 12 bp, Artificial Sequence
  synthetic [barcode part2]
aatgtgcttagc

SEQ ID NO: 46575 - DNA, 12 bp, Artificial Sequence
  synthetic [barcode part2]
ctaagccgtgca

SEQ ID NO: 46576 - DNA, 12 bp, Artificial Sequence
  synthetic [barcode part2]
cggtacacagct

SEQ ID NO: 46577 - DNA, 12 bp, Artificial Sequence
  synthetic [barcode part2]
ccggtgcagtta

SEQ ID NO: 46578 - DNA, 12 bp, Artificial Sequence
  synthetic [barcode part2]
tgtactactgga

SEQ ID NO: 46579 - DNA, 12 bp, Artificial Sequence
  synthetic [barcode part2]
tagacattggct

SEQ ID NO: 46580 - DNA, 12 bp, Artificial Sequence
  synthetic [barcode part2]
agctcaacgcac

SEQ ID NO: 46581 - DNA, 12 bp, Artificial Sequence
  synthetic [barcode part2]
atatagtctggc

SEQ ID NO: 46582 - DNA, 12 bp, Artificial Sequence
  synthetic [barcode part2]
ctgtatgagccg

SEQ ID NO: 46583 - DNA, 12 bp, Artificial Sequence
  synthetic [barcode part2]
ctattagacgca

SEQ ID NO: 46584 - DNA, 12 bp, Artificial Sequence
  synthetic [barcode part2]
acacacgtctct

SEQ ID NO: 46585 - DNA, 12 bp, Artificial Sequence
  synthetic [barcode part2]
caatggctacat

SEQ ID NO: 46586 - DNA, 12 bp, Artificial Sequence
  synthetic [barcode part2]
taagaccagagc

SEQ ID NO: 46587 - DNA, 12 bp, Artificial Sequence
  synthetic [barcode part2]
agcacatccagc

SEQ ID NO: 46588 - DNA, 12 bp, Artificial Sequence
  synthetic [barcode part2]
agcaacttacac

SEQ ID NO: 46589 - DNA, 12 bp, Artificial Sequence
  synthetic [barcode part2]
tagcataaccgt

SEQ ID NO: 46590 - DNA, 12 bp, Artificial Sequence
  synthetic [barcode part2]
cgtatacttccg

SEQ ID NO: 46591 - DNA, 12 bp, Artificial Sequence
  synthetic [barcode part2]
tgaacatcagct

SEQ ID NO: 46592 - DNA, 12 bp, Artificial Sequence
  synthetic [barcode part2]
acttggctatga

SEQ ID NO: 46593 - DNA, 12 bp, Artificial Sequence
  synthetic [barcode part2]
atggagacgcat

SEQ ID NO: 46594 - DNA, 12 bp, Artificial Sequence
  synthetic [barcode part2]
tatcaatagccg

SEQ ID NO: 46595 - DNA, 12 bp, Artificial Sequence
  synthetic [barcode part2]
caagctgtgcgt

SEQ ID NO: 46596 - DNA, 12 bp, Artificial Sequence
  synthetic [barcode part2]
cgctacactcta

SEQ ID NO: 46597 - DNA, 12 bp, Artificial Sequence
  synthetic [barcode part2]
agcagagcaatc

SEQ ID NO: 46598 - DNA, 12 bp, Artificial Sequence
  synthetic [barcode part2]
atcaccggcgta

SEQ ID NO: 46599 - DNA, 12 bp, Artificial Sequence
  synthetic [barcode part2]
ttcagagagagc

SEQ ID NO: 46600 - DNA, 12 bp, Artificial Sequence
  synthetic [barcode part2]
caataacacgct

SEQ ID NO: 46601 - DNA, 12 bp, Artificial Sequence
  synthetic [barcode part2]
tgagcacgctgt

SEQ ID NO: 46602 - DNA, 12 bp, Artificial Sequence
  synthetic [barcode part2]
taagcgttgatc

SEQ ID NO: 46603 - DNA, 12 bp, Artificial Sequence
  synthetic [barcode part2]
cgccagcttaga

SEQ ID NO: 46604 - DNA, 12 bp, Artificial Sequence
  synthetic [barcode part2]
agatggctgatg

SEQ ID NO: 46605 - DNA, 12 bp, Artificial Sequence
  synthetic [barcode part2]
caatagtgtgct

SEQ ID NO: 46606 - DNA, 12 bp, Artificial Sequence
  synthetic [barcode part2]
taccacgctcta

SEQ ID NO: 46607 - DNA, 12 bp, Artificial Sequence
  synthetic [barcode part2]
tacaccgctgga

SEQ ID NO: 46608 - DNA, 12 bp, Artificial Sequence
  synthetic [barcode part2]
ctccatagcact

SEQ ID NO: 46609 - DNA, 12 bp, Artificial Sequence
  synthetic [barcode part2]
tgttgatggcta

SEQ ID NO: 46610 - DNA, 12 bp, Artificial Sequence
  synthetic [barcode part2]
tgctaacaactg

SEQ ID NO: 46611 - DNA, 12 bp, Artificial Sequence
  synthetic [barcode part2]
catgctgaatca

SEQ ID NO: 46612 - DNA, 12 bp, Artificial Sequence
  synthetic [barcode part2]
ataagccactac

SEQ ID NO: 46613 - DNA, 12 bp, Artificial Sequence
  synthetic [barcode part2]
cagtgtagttac

SEQ ID NO: 46614 - DNA, 12 bp, Artificial Sequence
  synthetic [barcode part2]
cggctaatctct

SEQ ID NO: 46615 - DNA, 12 bp, Artificial Sequence
  synthetic [barcode part2]
cgcgttaccaga

SEQ ID NO: 46616 - DNA, 12 bp, Artificial Sequence
  synthetic [barcode part2]
ccgcatattaga

SEQ ID NO: 46617 - DNA, 12 bp, Artificial Sequence
  synthetic [barcode part2]
tgtcaatggtca

SEQ ID NO: 46618 - DNA, 12 bp, Artificial Sequence
  synthetic [barcode part2]
cagtatgatcac

SEQ ID NO: 46619 - DNA, 12 bp, Artificial Sequence
  synthetic [barcode part2]
cggatgtgttat

SEQ ID NO: 46620 - DNA, 12 bp, Artificial Sequence
  synthetic [barcode part2]
cggattgtgcgt

SEQ ID NO: 46621 - DNA, 12 bp, Artificial Sequence
  synthetic [barcode part2]
tgagcgttaact

SEQ ID NO: 46622 - DNA, 12 bp, Artificial Sequence
  synthetic [barcode part2]
atgttccgcact

SEQ ID NO: 46623 - DNA, 12 bp, Artificial Sequence
  synthetic [barcode part2]
tactcaatggca

SEQ ID NO: 46624 - DNA, 12 bp, Artificial Sequence
  synthetic [barcode part2]
atcactagcaca

SEQ ID NO: 46625 - DNA, 12 bp, Artificial Sequence
  synthetic [barcode part2]
tgacaatacgct

SEQ ID NO: 46626 - DNA, 12 bp, Artificial Sequence
  synthetic [barcode part2]
aactcaacacgt

SEQ ID NO: 46627 - DNA, 12 bp, Artificial Sequence
  synthetic [barcode part2]
tacagccattga

SEQ ID NO: 46628 - DNA, 12 bp, Artificial Sequence
  synthetic [barcode part2]
tgtgaagcgtga

SEQ ID NO: 46629 - DNA, 12 bp, Artificial Sequence
  synthetic [barcode part2]
ccgtgatagaga

SEQ ID NO: 46630 - DNA, 12 bp, Artificial Sequence
  synthetic [barcode part2]
ccagattatacg

SEQ ID NO: 46631 - DNA, 12 bp, Artificial Sequence
  synthetic [barcode part2]
tctgagagaagc

SEQ ID NO: 46632 - DNA, 12 bp, Artificial Sequence
  synthetic [barcode part2]
ccagagatagtg

SEQ ID NO: 46633 - DNA, 12 bp, Artificial Sequence
  synthetic [barcode part2]
aacaactgtgct

SEQ ID NO: 46634 - DNA, 12 bp, Artificial Sequence
  synthetic [barcode part2]
tagcaattgcgt

SEQ ID NO: 46635 - DNA, 12 bp, Artificial Sequence
  synthetic [barcode part2]
catggctgctga

SEQ ID NO: 46636 - DNA, 12 bp, Artificial Sequence
  synthetic [barcode part2]
atgcgtggaagt

SEQ ID NO: 46637 - DNA, 12 bp, Artificial Sequence
  synthetic [barcode part2]
cagaactgaagc

SEQ ID NO: 46638 - DNA, 12 bp, Artificial Sequence
  synthetic [barcode part2]
cagatgtgctgc

SEQ ID NO: 46639 - DNA, 12 bp, Artificial Sequence
  synthetic [barcode part2]
cttgcacatgtc

SEQ ID NO: 46640 - DNA, 12 bp, Artificial Sequence
  synthetic [barcode part2]
caatgtagccat

SEQ ID NO: 46641 - DNA, 12 bp, Artificial Sequence
  synthetic [barcode part2]
ctcatcaaccgt

SEQ ID NO: 46642 - DNA, 12 bp, Artificial Sequence
  synthetic [barcode part2]
acagaagcgcat

SEQ ID NO: 46643 - DNA, 12 bp, Artificial Sequence
  synthetic [barcode part2]
taagctgtgtac

SEQ ID NO: 46644 - DNA, 12 bp, Artificial Sequence
  synthetic [barcode part2]
cgtcaatggctg

SEQ ID NO: 46645 - DNA, 12 bp, Artificial Sequence
  synthetic [barcode part2]
ccggcacaacta

SEQ ID NO: 46646 - DNA, 12 bp, Artificial Sequence
  synthetic [barcode part2]
ctcactagccat

SEQ ID NO: 46647 - DNA, 12 bp, Artificial Sequence
  synthetic [barcode part2]
ctcatgttgcgt

SEQ ID NO: 46648 - DNA, 12 bp, Artificial Sequence
  synthetic [barcode part2]
agtgagagccat

SEQ ID NO: 46649 - DNA, 12 bp, Artificial Sequence
  synthetic [barcode part2]
ctgagagtaacg

SEQ ID NO: 46650 - DNA, 12 bp, Artificial Sequence
  synthetic [barcode part2]
cattaacggtca

SEQ ID NO: 46651 - DNA, 12 bp, Artificial Sequence
  synthetic [barcode part2]
cattggcttaga

SEQ ID NO: 46652 - DNA, 12 bp, Artificial Sequence
  synthetic [barcode part2]
tgtccagtagta

SEQ ID NO: 46653 - DNA, 12 bp, Artificial Sequence
  synthetic [barcode part2]
agcttgatgcgc

SEQ ID NO: 46654 - DNA, 12 bp, Artificial Sequence
  synthetic [barcode part2]
ctcataccacgt

SEQ ID NO: 46655 - DNA, 12 bp, Artificial Sequence
  synthetic [barcode part2]
ttggcgtagcca

SEQ ID NO: 46656 - DNA, 12 bp, Artificial Sequence
  synthetic [barcode part2]
catccagtgata

SEQ ID NO: 46657 - DNA, 12 bp, Artificial Sequence
  synthetic [barcode part2]
catcacggaaga

SEQ ID NO: 46658 - DNA, 12 bp, Artificial Sequence
  synthetic [barcode part2]
tacggctcaata

SEQ ID NO: 46659 - DNA, 12 bp, Artificial Sequence
  synthetic [barcode part2]
ttgcggtgaaga

SEQ ID NO: 46660 - DNA, 12 bp, Artificial Sequence
  synthetic [barcode part2]
ttcactagctgc

SEQ ID NO: 46661 - DNA, 12 bp, Artificial Sequence
  synthetic [barcode part2]
ttgcgcagacca

SEQ ID NO: 46662 - DNA, 12 bp, Artificial Sequence
  synthetic [barcode part2]
tcagccattcca

SEQ ID NO: 46663 - DNA, 12 bp, Artificial Sequence
  synthetic [barcode part2]
agctgtaagttc

SEQ ID NO: 46664 - DNA, 12 bp, Artificial Sequence
  synthetic [barcode part2]
tatggcttaacg

SEQ ID NO: 46665 - DNA, 12 bp, Artificial Sequence
  synthetic [barcode part2]
ttgcgcaagtta

SEQ ID NO: 46666 - DNA, 12 bp, Artificial Sequence
  synthetic [barcode part2]
actacgcgctga

SEQ ID NO: 46667 - DNA, 12 bp, Artificial Sequence
  synthetic [barcode part2]
cttggctgattc

SEQ ID NO: 46668 - DNA, 12 bp, Artificial Sequence
  synthetic [barcode part2]
tcacgcaagcca

SEQ ID NO: 46669 - DNA, 12 bp, Artificial Sequence
  synthetic [barcode part2]
cgctaacggcta

SEQ ID NO: 46670 - DNA, 12 bp, Artificial Sequence
  synthetic [barcode part2]
cgcaactgctga

SEQ ID NO: 46671 - DNA, 12 bp, Artificial Sequence
  synthetic [barcode part2]
cattgcgttcca

SEQ ID NO: 46672 - DNA, 12 bp, Artificial Sequence
  synthetic [barcode part2]
atcacgcattga

SEQ ID NO: 46673 - DNA, 12 bp, Artificial Sequence
  synthetic [barcode part2]
atccagcgcaca

SEQ ID NO: 46674 - DNA, 12 bp, Artificial Sequence
  synthetic [barcode part2]
tcaccagatgta

SEQ ID NO: 46675 - DNA, 12 bp, Artificial Sequence
  synthetic [barcode part2]
actggctcttca

SEQ ID NO: 46676 - DNA, 12 bp, Artificial Sequence
  synthetic [barcode part2]
atcattgacgca

SEQ ID NO: 46677 - DNA, 12 bp, Artificial Sequence
  synthetic [barcode part2]
ctccgtgtgtat

SEQ ID NO: 46678 - DNA, 12 bp, Artificial Sequence
  synthetic [barcode part2]
ccgcgtgaatca

SEQ ID NO: 46679 - DNA, 12 bp, Artificial Sequence
  synthetic [barcode part2]
cagcggttacac

SEQ ID NO: 46680 - DNA, 12 bp, Artificial Sequence
  synthetic [barcode part2]
cttatacgcgtc

SEQ ID NO: 46681 - DNA, 12 bp, Artificial Sequence
  synthetic [barcode part2]
taccggtccaga

SEQ ID NO: 46682 - DNA, 12 bp, Artificial Sequence
  synthetic [barcode part2]
ctcacgcatact

SEQ ID NO: 46683 - DNA, 12 bp, Artificial Sequence
  synthetic [barcode part2]
ctgccagatgtg

SEQ ID NO: 46684 - DNA, 12 bp, Artificial Sequence
  synthetic [barcode part2]
cttcacggtatc

SEQ ID NO: 46685 - DNA, 12 bp, Artificial Sequence
  synthetic [barcode part2]
actcaatgcaca

SEQ ID NO: 46686 - DNA, 12 bp, Artificial Sequence
  synthetic [barcode part2]
acgctaagctgc

SEQ ID NO: 46687 - DNA, 12 bp, Artificial Sequence
  synthetic [barcode part2]
tagcgcagccat

SEQ ID NO: 46688 - DNA, 12 bp, Artificial Sequence
  synthetic [barcode part2]
atgcagcaatct

SEQ ID NO: 46689 - DNA, 12 bp, Artificial Sequence
  synthetic [barcode part2]
tcagtgcggcta

SEQ ID NO: 46690 - DNA, 12 bp, Artificial Sequence
  synthetic [barcode part2]
cttgaagctctc

SEQ ID NO: 46691 - DNA, 12 bp, Artificial Sequence
  synthetic [barcode part2]
aacggaacagct

SEQ ID NO: 46692 - DNA, 12 bp, Artificial Sequence
  synthetic [barcode part2]
cattgatagcca

SEQ ID NO: 46693 - DNA, 12 bp, Artificial Sequence
  synthetic [barcode part2]
atagaagcacgc

SEQ ID NO: 46694 - DNA, 12 bp, Artificial Sequence
  synthetic [barcode part2]
tgtctggtgata

SEQ ID NO: 46695 - DNA, 12 bp, Artificial Sequence
  synthetic [barcode part2]
attcagcacatg

SEQ ID NO: 46696 - DNA, 12 bp, Artificial Sequence
  synthetic [barcode part2]
ccagcacagttg

SEQ ID NO: 46697 - DNA, 12 bp, Artificial Sequence
  synthetic [barcode part2]
tagcgtgatcat

SEQ ID NO: 46698 - DNA, 12 bp, Artificial Sequence
  synthetic [barcode part2]
ccagtatggctg

SEQ ID NO: 46699 - DNA, 12 bp, Artificial Sequence
  synthetic [barcode part2]
ctaacatccaga

SEQ ID NO: 46700 - DNA, 12 bp, Artificial Sequence
  synthetic [barcode part2]
cgctcaacggta

SEQ ID NO: 46701 - DNA, 12 bp, Artificial Sequence
  synthetic [barcode part2]
aacggcttgtat

SEQ ID NO: 46702 - DNA, 12 bp, Artificial Sequence
  synthetic [barcode part2]
atgtcaacagct

SEQ ID NO: 46703 - DNA, 12 bp, Artificial Sequence
  synthetic [barcode part2]
ttgccagataca

SEQ ID NO: 46704 - DNA, 12 bp, Artificial Sequence
  synthetic [barcode part2]
ttatgtaagccg

SEQ ID NO: 46705 - DNA, 12 bp, Artificial Sequence
  synthetic [barcode part2]
acatctcacgct

SEQ ID NO: 46706 - DNA, 12 bp, Artificial Sequence
  synthetic [barcode part2]
ttgctggacgca

SEQ ID NO: 46707 - DNA, 12 bp, Artificial Sequence
  synthetic [barcode part2]
ccgctaatatga

SEQ ID NO: 46708 - DNA, 12 bp, Artificial Sequence
  synthetic [barcode part2]
ctgaactgtatg

SEQ ID NO: 46709 - DNA, 12 bp, Artificial Sequence
  synthetic [barcode part2]
cttgtgcacatc

SEQ ID NO: 46710 - DNA, 12 bp, Artificial Sequence
  synthetic [barcode part2]
attatcagcacg

SEQ ID NO: 46711 - DNA, 12 bp, Artificial Sequence
  synthetic [barcode part2]
ctaatgtctgga

SEQ ID NO: 46712 - DNA, 12 bp, Artificial Sequence
  synthetic [barcode part2]
cgctgatagtta

SEQ ID NO: 46713 - DNA, 12 bp, Artificial Sequence
  synthetic [barcode part2]
acactctacgct

SEQ ID NO: 46714 - DNA, 12 bp, Artificial Sequence
  synthetic [barcode part2]
ttcttccagagc

SEQ ID NO: 46715 - DNA, 12 bp, Artificial Sequence
  synthetic [barcode part2]
ccgcacggatta

SEQ ID NO: 46716 - DNA, 12 bp, Artificial Sequence
  synthetic [barcode part2]
attccagctctg

SEQ ID NO: 46717 - DNA, 12 bp, Artificial Sequence
  synthetic [barcode part2]
ccgtgtaccaga

SEQ ID NO: 46718 - DNA, 12 bp, Artificial Sequence
  synthetic [barcode part2]
agcacatgattc

SEQ ID NO: 46719 - DNA, 12 bp, Artificial Sequence
  synthetic [barcode part2]
ctaatgtggcta

SEQ ID NO: 46720 - DNA, 12 bp, Artificial Sequence
  synthetic [barcode part2]
aatagccgtatc

SEQ ID NO: 46721 - DNA, 12 bp, Artificial Sequence
  synthetic [barcode part2]
cttgaccaactc

SEQ ID NO: 46722 - DNA, 12 bp, Artificial Sequence
  synthetic [barcode part2]
agcggctatgtc

SEQ ID NO: 46723 - DNA, 12 bp, Artificial Sequence
  synthetic [barcode part2]
accgtatcagcg

SEQ ID NO: 46724 - DNA, 12 bp, Artificial Sequence
  synthetic [barcode part2]
cgtctaacagcg

SEQ ID NO: 46725 - DNA, 12 bp, Artificial Sequence
  synthetic [barcode part2]
tccgtatacgct

SEQ ID NO: 46726 - DNA, 12 bp, Artificial Sequence
  synthetic [barcode part2]
tacagttgctga

SEQ ID NO: 46727 - DNA, 12 bp, Artificial Sequence
  synthetic [barcode part2]
cgccaatccaga

SEQ ID NO: 46728 - DNA, 12 bp, Artificial Sequence
  synthetic [barcode part2]
aagagttggctg

SEQ ID NO: 46729 - DNA, 12 bp, Artificial Sequence
  synthetic [barcode part2]
ctggagataacg

SEQ ID NO: 46730 - DNA, 12 bp, Artificial Sequence
  synthetic [barcode part2]
catactaccaga

SEQ ID NO: 46731 - DNA, 12 bp, Artificial Sequence
  synthetic [barcode part2]
atccgtgcaata

SEQ ID NO: 46732 - DNA, 12 bp, Artificial Sequence
  synthetic [barcode part2]
agctgcgttgac

SEQ ID NO: 46733 - DNA, 12 bp, Artificial Sequence
  synthetic [barcode part2]
ctccagcattgt

SEQ ID NO: 46734 - DNA, 12 bp, Artificial Sequence
  synthetic [barcode part2]
tgagccacgtgt

SEQ ID NO: 46735 - DNA, 12 bp, Artificial Sequence
  synthetic [barcode part2]
ttcaactggctc

SEQ ID NO: 46736 - DNA, 12 bp, Artificial Sequence
  synthetic [barcode part2]
atgttgagctgt

SEQ ID NO: 46737 - DNA, 12 bp, Artificial Sequence
  synthetic [barcode part2]
cattggcagtta

SEQ ID NO: 46738 - DNA, 12 bp, Artificial Sequence
  synthetic [barcode part2]
catatcactgga

SEQ ID NO: 46739 - DNA, 12 bp, Artificial Sequence
  synthetic [barcode part2]
tgtcagcaatca

SEQ ID NO: 46740 - DNA, 12 bp, Artificial Sequence
  synthetic [barcode part2]
ttgctctcagca

SEQ ID NO: 46741 - DNA, 12 bp, Artificial Sequence
  synthetic [barcode part2]
ctccaatgctgt

SEQ ID NO: 46742 - DNA, 12 bp, Artificial Sequence
  synthetic [barcode part2]
catgcactctca

SEQ ID NO: 46743 - DNA, 12 bp, Artificial Sequence
  synthetic [barcode part2]
cggtagtacgct

SEQ ID NO: 46744 - DNA, 12 bp, Artificial Sequence
  synthetic [barcode part2]
cgcaatctaaca

SEQ ID NO: 46745 - DNA, 12 bp, Artificial Sequence
  synthetic [barcode part2]
caagcacactat

SEQ ID NO: 46746 - DNA, 12 bp, Artificial Sequence
  synthetic [barcode part2]
tgatgcgcagct

SEQ ID NO: 46747 - DNA, 12 bp, Artificial Sequence
  synthetic [barcode part2]
agttcaagtgct

SEQ ID NO: 46748 - DNA, 12 bp, Artificial Sequence
  synthetic [barcode part2]
agccatagattc

SEQ ID NO: 46749 - DNA, 12 bp, Artificial Sequence
  synthetic [barcode part2]
ctaagccacata

SEQ ID NO: 46750 - DNA, 12 bp, Artificial Sequence
  synthetic [barcode part2]
ttgatacagcca

SEQ ID NO: 46751 - DNA, 12 bp, Artificial Sequence
  synthetic [barcode part2]
actgaagccaga

SEQ ID NO: 46752 - DNA, 12 bp, Artificial Sequence
  synthetic [barcode part2]
ctatgcgccaga

SEQ ID NO: 46753 - DNA, 12 bp, Artificial Sequence
  synthetic [barcode part2]
cagatcacgcac

SEQ ID NO: 46754 - DNA, 12 bp, Artificial Sequence
  synthetic [barcode part2]
acgcagcttagc

SEQ ID NO: 46755 - DNA, 12 bp, Artificial Sequence
  synthetic [barcode part2]
aatatacggctc

SEQ ID NO: 46756 - DNA, 12 bp, Artificial Sequence
  synthetic [barcode part2]
acgtgatagttc

SEQ ID NO: 46757 - DNA, 12 bp, Artificial Sequence
  synthetic [barcode part2]
ctgaatcacatg

SEQ ID NO: 46758 - DNA, 12 bp, Artificial Sequence
  synthetic [barcode part2]
cagctaagaagc

SEQ ID NO: 46759 - DNA, 12 bp, Artificial Sequence
  synthetic [barcode part2]
cagacgccaatc

SEQ ID NO: 46760 - DNA, 12 bp, Artificial Sequence
  synthetic [barcode part2]
cttcagccaatc

SEQ ID NO: 46761 - DNA, 12 bp, Artificial Sequence
  synthetic [barcode part2]
actgtatcgaca

SEQ ID NO: 46762 - DNA, 12 bp, Artificial Sequence
  synthetic [barcode part2]
aatgtgcagttc

SEQ ID NO: 46763 - DNA, 12 bp, Artificial Sequence
  synthetic [barcode part2]
actcgtgcagca

SEQ ID NO: 46764 - DNA, 12 bp, Artificial Sequence
  synthetic [barcode part2]
ccgcttcattga

SEQ ID NO: 46765 - DNA, 12 bp, Artificial Sequence
  synthetic [barcode part2]
cagtggcgtatc

SEQ ID NO: 46766 - DNA, 12 bp, Artificial Sequence
  synthetic [barcode part2]
aatgattcacgc

SEQ ID NO: 46767 - DNA, 12 bp, Artificial Sequence
  synthetic [barcode part2]
cgtagagatacg

SEQ ID NO: 46768 - DNA, 12 bp, Artificial Sequence
  synthetic [barcode part2]
agtgtgctcaat

SEQ ID NO: 46769 - DNA, 12 bp, Artificial Sequence
  synthetic [barcode part2]
agaactatggcg

SEQ ID NO: 46770 - DNA, 12 bp, Artificial Sequence
  synthetic [barcode part2]
cagcacgcaatc

SEQ ID NO: 46771 - DNA, 12 bp, Artificial Sequence
  synthetic [barcode part2]
ctgcgtgagttg

SEQ ID NO: 46772 - DNA, 12 bp, Artificial Sequence
  synthetic [barcode part2]
atagctgtcaac

SEQ ID NO: 46773 - DNA, 12 bp, Artificial Sequence
  synthetic [barcode part2]
cttcttcgagac

SEQ ID NO: 46774 - DNA, 12 bp, Artificial Sequence
  synthetic [barcode part2]
aagagccaactg

SEQ ID NO: 46775 - DNA, 12 bp, Artificial Sequence
  synthetic [barcode part2]
ccgactattcca

SEQ ID NO: 46776 - DNA, 12 bp, Artificial Sequence
  synthetic [barcode part2]
cggactaatact

SEQ ID NO: 46777 - DNA, 12 bp, Artificial Sequence
  synthetic [barcode part2]
atcgcgtcaata

SEQ ID NO: 46778 - DNA, 12 bp, Artificial Sequence
  synthetic [barcode part2]
agcatactcggc

SEQ ID NO: 46779 - DNA, 12 bp, Artificial Sequence
  synthetic [barcode part2]
acaagccattgt

SEQ ID NO: 46780 - DNA, 12 bp, Artificial Sequence
  synthetic [barcode part2]
cgagccatatgc

SEQ ID NO: 46781 - DNA, 12 bp, Artificial Sequence
  synthetic [barcode part2]
cggcaattatgt

SEQ ID NO: 46782 - DNA, 12 bp, Artificial Sequence
  synthetic [barcode part2]
ctacgtgaacta

SEQ ID NO: 46783 - DNA, 12 bp, Artificial Sequence
  synthetic [barcode part2]
agctcaatatgc

SEQ ID NO: 46784 - DNA, 12 bp, Artificial Sequence
  synthetic [barcode part2]
acggctgaactc

SEQ ID NO: 46785 - DNA, 12 bp, Artificial Sequence
  synthetic [barcode part2]
cagaatcagagc

SEQ ID NO: 46786 - DNA, 12 bp, Artificial Sequence
  synthetic [barcode part2]
cgaatacgctgc

SEQ ID NO: 46787 - DNA, 12 bp, Artificial Sequence
  synthetic [barcode part2]
ctggcgtagttg

SEQ ID NO: 46788 - DNA, 12 bp, Artificial Sequence
  synthetic [barcode part2]
aagcgcaatacg

SEQ ID NO: 46789 - DNA, 12 bp, Artificial Sequence
  synthetic [barcode part2]
agttcaatgcgt

SEQ ID NO: 46790 - DNA, 12 bp, Artificial Sequence
  synthetic [barcode part2]
atagccactaac

SEQ ID NO: 46791 - DNA, 12 bp, Artificial Sequence
  synthetic [barcode part2]
caacacggccat

SEQ ID NO: 46792 - DNA, 12 bp, Artificial Sequence
  synthetic [barcode part2]
acttctctcgga

SEQ ID NO: 46793 - DNA, 12 bp, Artificial Sequence
  synthetic [barcode part2]
catggaagcaca

SEQ ID NO: 46794 - DNA, 12 bp, Artificial Sequence
  synthetic [barcode part2]
cgaatcagcgtc

SEQ ID NO: 46795 - DNA, 12 bp, Artificial Sequence
  synthetic [barcode part2]
cagtagtatgtc

SEQ ID NO: 46796 - DNA, 12 bp, Artificial Sequence
  synthetic [barcode part2]
agttctctggct

SEQ ID NO: 46797 - DNA, 12 bp, Artificial Sequence
  synthetic [barcode part2]
aagcagctgatg

SEQ ID NO: 46798 - DNA, 12 bp, Artificial Sequence
  synthetic [barcode part2]
cttggaagaagc

SEQ ID NO: 46799 - DNA, 12 bp, Artificial Sequence
  synthetic [barcode part2]
cgaacgctgatc

SEQ ID NO: 46800 - DNA, 12 bp, Artificial Sequence
  synthetic [barcode part2]
aactctccagct

SEQ ID NO: 46801 - DNA, 12 bp, Artificial Sequence
  synthetic [barcode part2]
ctctgtacgtgt

SEQ ID NO: 46802 - DNA, 12 bp, Artificial Sequence
  synthetic [barcode part2]
acgtacactctc

SEQ ID NO: 46803 - DNA, 12 bp, Artificial Sequence
  synthetic [barcode part2]
ctgttgaatgtg

SEQ ID NO: 46804 - DNA, 12 bp, Artificial Sequence
  synthetic [barcode part2]
acttgtagctga

SEQ ID NO: 46805 - DNA, 12 bp, Artificial Sequence
  synthetic [barcode part2]
actgcgtcagca

SEQ ID NO: 46806 - DNA, 12 bp, Artificial Sequence
  synthetic [barcode part2]
cagcatatgatc

SEQ ID NO: 46807 - DNA, 12 bp, Artificial Sequence
  synthetic [barcode part2]
catgattcagca

SEQ ID NO: 46808 - DNA, 12 bp, Artificial Sequence
  synthetic [barcode part2]
agcttagcacgc

SEQ ID NO: 46809 - DNA, 12 bp, Artificial Sequence
  synthetic [barcode part2]
cattgcgagaga

SEQ ID NO: 46810 - DNA, 12 bp, Artificial Sequence
  synthetic [barcode part2]
atacacggaagc

SEQ ID NO: 46811 - DNA, 12 bp, Artificial Sequence
  synthetic [barcode part2]
acatggctcaat

SEQ ID NO: 46812 - DNA, 12 bp, Artificial Sequence
  synthetic [barcode part2]
agccgtgctaac

SEQ ID NO: 46813 - DNA, 12 bp, Artificial Sequence
  synthetic [barcode part2]
cggacgcatcat

SEQ ID NO: 46814 - DNA, 12 bp, Artificial Sequence
  synthetic [barcode part2]
actactagcgta

SEQ ID NO: 46815 - DNA, 12 bp, Artificial Sequence
  synthetic [barcode part2]
acgtgtagagac

SEQ ID NO: 46816 - DNA, 12 bp, Artificial Sequence
  synthetic [barcode part2]
atgagccatcat

SEQ ID NO: 46817 - DNA, 12 bp, Artificial Sequence
  synthetic [barcode part2]
actgtcgcgtga

SEQ ID NO: 46818 - DNA, 12 bp, Artificial Sequence
  synthetic [barcode part2]
aagatgtgcgtg

SEQ ID NO: 46819 - DNA, 12 bp, Artificial Sequence
  synthetic [barcode part2]
ccattgaatacg

SEQ ID NO: 46820 - DNA, 12 bp, Artificial Sequence
  synthetic [barcode part2]
acttggcatgta

SEQ ID NO: 46821 - DNA, 12 bp, Artificial Sequence
  synthetic [barcode part2]
ccgatgtaacta

SEQ ID NO: 46822 - DNA, 12 bp, Artificial Sequence
  synthetic [barcode part2]
atcgtcggcaca

SEQ ID NO: 46823 - DNA, 12 bp, Artificial Sequence
  synthetic [barcode part2]
cgcatgtcttca

SEQ ID NO: 46824 - DNA, 12 bp, Artificial Sequence
  synthetic [barcode part2]
cgcgaagacata

SEQ ID NO: 46825 - DNA, 12 bp, Artificial Sequence
  synthetic [barcode part2]
actgtgctaaca

SEQ ID NO: 46826 - DNA, 12 bp, Artificial Sequence
  synthetic [barcode part2]
atgaatccagct

SEQ ID NO: 46827 - DNA, 12 bp, Artificial Sequence
  synthetic [barcode part2]
ccgtcaagcgta

SEQ ID NO: 46828 - DNA, 12 bp, Artificial Sequence
  synthetic [barcode part2]
acggattcaatc

SEQ ID NO: 46829 - DNA, 12 bp, Artificial Sequence
  synthetic [barcode part2]
actgtcgataca

SEQ ID NO: 46830 - DNA, 12 bp, Artificial Sequence
  synthetic [barcode part2]
ctgccgaatacg

SEQ ID NO: 46831 - DNA, 12 bp, Artificial Sequence
  synthetic [barcode part2]
ccagcgtgattg

SEQ ID NO: 46832 - DNA, 12 bp, Artificial Sequence
  synthetic [barcode part2]
atatggcttagc

SEQ ID NO: 46833 - DNA, 12 bp, Artificial Sequence
  synthetic [barcode part2]
atgcttccacgt

SEQ ID NO: 46834 - DNA, 12 bp, Artificial Sequence
  synthetic [barcode part2]
atcgtgcgctga

SEQ ID NO: 46835 - DNA, 12 bp, Artificial Sequence
  synthetic [barcode part2]
actcgcatggca

SEQ ID NO: 46836 - DNA, 12 bp, Artificial Sequence
  synthetic [barcode part2]
ctacgtgtcgga

SEQ ID NO: 46837 - DNA, 12 bp, Artificial Sequence
  synthetic [barcode part2]
acgagccgttac

SEQ ID NO: 46838 - DNA, 12 bp, Artificial Sequence
  synthetic [barcode part2]
cgcgctgaacta

SEQ ID NO: 46839 - DNA, 12 bp, Artificial Sequence
  synthetic [barcode part2]
agttggctctct

SEQ ID NO: 46840 - DNA, 12 bp, Artificial Sequence
  synthetic [barcode part2]
cagtgatcatac

SEQ ID NO: 46841 - DNA, 12 bp, Artificial Sequence
  synthetic [barcode part2]
cggacatattgt

SEQ ID NO: 46842 - DNA, 12 bp, Artificial Sequence
  synthetic [barcode part2]
acgtaacggctc

SEQ ID NO: 46843 - DNA, 12 bp, Artificial Sequence
  synthetic [barcode part2]
agaatgtgcacg

SEQ ID NO: 46844 - DNA, 12 bp, Artificial Sequence
  synthetic [barcode part2]
cagatgtatcac

SEQ ID NO: 46845 - DNA, 12 bp, Artificial Sequence
  synthetic [barcode part2]
ctgtctccaatg

SEQ ID NO: 46846 - DNA, 12 bp, Artificial Sequence
  synthetic [barcode part2]
caagcgtgttat

SEQ ID NO: 46847 - DNA, 12 bp, Artificial Sequence
  synthetic [barcode part2]
actgtcggcgta

SEQ ID NO: 46848 - DNA, 12 bp, Artificial Sequence
  synthetic [barcode part2]
ctcggcttcaat

SEQ ID NO: 46849 - DNA, 12 bp, Artificial Sequence
  synthetic [barcode part2]
atcgccacacga

SEQ ID NO: 46850 - DNA, 12 bp, Artificial Sequence
  synthetic [barcode part2]
catgagagtgca

SEQ ID NO: 46851 - DNA, 12 bp, Artificial Sequence
  synthetic [barcode part2]
attgtgctgatg

SEQ ID NO: 46852 - DNA, 12 bp, Artificial Sequence
  synthetic [barcode part2]
atcggctctcta

SEQ ID NO: 46853 - DNA, 12 bp, Artificial Sequence
  synthetic [barcode part2]
cggatcacacgt

SEQ ID NO: 46854 - DNA, 12 bp, Artificial Sequence
  synthetic [barcode part2]
cgctgtattcca

SEQ ID NO: 46855 - DNA, 12 bp, Artificial Sequence
  synthetic [barcode part2]
acgcaatgattc

SEQ ID NO: 46856 - DNA, 12 bp, Artificial Sequence
  synthetic [barcode part2]
acgcaatccagc

SEQ ID NO: 46857 - DNA, 12 bp, Artificial Sequence
  synthetic [barcode part2]
ctggaagtagtg

SEQ ID NO: 46858 - DNA, 12 bp, Artificial Sequence
  synthetic [barcode part2]
agtcacgctaat

SEQ ID NO: 46859 - DNA, 12 bp, Artificial Sequence
  synthetic [barcode part2]
agtaatcgtgct

SEQ ID NO: 46860 - DNA, 12 bp, Artificial Sequence
  synthetic [barcode part2]
agctatgctggc

SEQ ID NO: 46861 - DNA, 12 bp, Artificial Sequence
  synthetic [barcode part2]
atctagttgcga

SEQ ID NO: 46862 - DNA, 12 bp, Artificial Sequence
  synthetic [barcode part2]
caacgcaactat

SEQ ID NO: 46863 - DNA, 12 bp, Artificial Sequence
  synthetic [barcode part2]
ctctaacgtcgt

SEQ ID NO: 46864 - DNA, 12 bp, Artificial Sequence
  synthetic [barcode part2]
cttccagtcaac

SEQ ID NO: 46865 - DNA, 12 bp, Artificial Sequence
  synthetic [barcode part2]
ctctatgtgcgt

SEQ ID NO: 46866 - DNA, 12 bp, Artificial Sequence
  synthetic [barcode part2]
ctatacatcgga

SEQ ID NO: 46867 - DNA, 12 bp, Artificial Sequence
  synthetic [barcode part2]
agctacactaac

SEQ ID NO: 46868 - DNA, 12 bp, Artificial Sequence
  synthetic [barcode part2]
ccgcttctaaca

SEQ ID NO: 46869 - DNA, 12 bp, Artificial Sequence
  synthetic [barcode part2]
cacattgagttg

SEQ ID NO: 46870 - DNA, 12 bp, Artificial Sequence
  synthetic [barcode part2]
ccatcaagtatg

SEQ ID NO: 46871 - DNA, 12 bp, Artificial Sequence
  synthetic [barcode part2]
acgcttcatgtc

SEQ ID NO: 46872 - DNA, 12 bp, Artificial Sequence
  synthetic [barcode part2]
agtcttccagct

SEQ ID NO: 46873 - DNA, 12 bp, Artificial Sequence
  synthetic [barcode part2]
atatgcggagac

SEQ ID NO: 46874 - DNA, 12 bp, Artificial Sequence
  synthetic [barcode part2]
atgcgcaagagt

SEQ ID NO: 46875 - DNA, 12 bp, Artificial Sequence
  synthetic [barcode part2]
acggccatcaac

SEQ ID NO: 46876 - DNA, 12 bp, Artificial Sequence
  synthetic [barcode part2]
ccgaatcgcgta

SEQ ID NO: 46877 - DNA, 12 bp, Artificial Sequence
  synthetic [barcode part2]
aagctggagttg

SEQ ID NO: 46878 - DNA, 12 bp, Artificial Sequence
  synthetic [barcode part2]
cgccagcagtta

SEQ ID NO: 46879 - DNA, 12 bp, Artificial Sequence
  synthetic [barcode part2]
catccgacaata

SEQ ID NO: 46880 - DNA, 12 bp, Artificial Sequence
  synthetic [barcode part2]
catgcgtcttca

SEQ ID NO: 46881 - DNA, 12 bp, Artificial Sequence
  synthetic [barcode part2]
aatcacggattc

SEQ ID NO: 46882 - DNA, 12 bp, Artificial Sequence
  synthetic [barcode part2]
cgcttagcagca

SEQ ID NO: 46883 - DNA, 12 bp, Artificial Sequence
  synthetic [barcode part2]
cggcgtgactat

SEQ ID NO: 46884 - DNA, 12 bp, Artificial Sequence
  synthetic [barcode part2]
ctggattgcacg

SEQ ID NO: 46885 - DNA, 12 bp, Artificial Sequence
  synthetic [barcode part2]
cagattgtacac

SEQ ID NO: 46886 - DNA, 12 bp, Artificial Sequence
  synthetic [barcode part2]
cgttcaatggcg

SEQ ID NO: 46887 - DNA, 12 bp, Artificial Sequence
  synthetic [barcode part2]
ctgacatggctg

SEQ ID NO: 46888 - DNA, 12 bp, Artificial Sequence
  synthetic [barcode part2]
cagcttcagttc

SEQ ID NO: 46889 - DNA, 12 bp, Artificial Sequence
  synthetic [barcode part2]
atactaagccac

SEQ ID NO: 46890 - DNA, 12 bp, Artificial Sequence
  synthetic [barcode part2]
agatgtaacgcg

SEQ ID NO: 46891 - DNA, 12 bp, Artificial Sequence
  synthetic [barcode part2]
atgctggcagct

SEQ ID NO: 46892 - DNA, 12 bp, Artificial Sequence
  synthetic [barcode part2]
cgcaacttagta

SEQ ID NO: 46893 - DNA, 12 bp, Artificial Sequence
  synthetic [barcode part2]
atgcgcagagat

SEQ ID NO: 46894 - DNA, 12 bp, Artificial Sequence
  synthetic [barcode part2]
cgttgtactctg

SEQ ID NO: 46895 - DNA, 12 bp, Artificial Sequence
  synthetic [barcode part2]
acttgatgcgta

SEQ ID NO: 46896 - DNA, 12 bp, Artificial Sequence
  synthetic [barcode part2]
cggacatgccat

SEQ ID NO: 46897 - DNA, 12 bp, Artificial Sequence
  synthetic [barcode part2]
cacaactcaatg

SEQ ID NO: 46898 - DNA, 12 bp, Artificial Sequence
  synthetic [barcode part2]
ctagagatggca

SEQ ID NO: 46899 - DNA, 12 bp, Artificial Sequence
  synthetic [barcode part2]
ctgcaattctcg

SEQ ID NO: 46900 - DNA, 12 bp, Artificial Sequence
  synthetic [barcode part2]
atccgacgtgca

SEQ ID NO: 46901 - DNA, 12 bp, Artificial Sequence
  synthetic [barcode part2]
ctcttagccgat

SEQ ID NO: 46902 - DNA, 12 bp, Artificial Sequence
  synthetic [barcode part2]
cgcacatgaaga

SEQ ID NO: 46903 - DNA, 12 bp, Artificial Sequence
  synthetic [barcode part2]
cgcattgctgga

SEQ ID NO: 46904 - DNA, 12 bp, Artificial Sequence
  synthetic [barcode part2]
ctactggatgta

SEQ ID NO: 46905 - DNA, 12 bp, Artificial Sequence
  synthetic [barcode part2]
cgttagtagttg

SEQ ID NO: 46906 - DNA, 12 bp, Artificial Sequence
  synthetic [barcode part2]
aacgagagctgt

SEQ ID NO: 46907 - DNA, 12 bp, Artificial Sequence
  synthetic [barcode part2]
attacatcagcg

SEQ ID NO: 46908 - DNA, 12 bp, Artificial Sequence
  synthetic [barcode part2]
ccgagttgtgca

SEQ ID NO: 46909 - DNA, 12 bp, Artificial Sequence
  synthetic [barcode part2]
caagccatgtat

SEQ ID NO: 46910 - DNA, 12 bp, Artificial Sequence
  synthetic [barcode part2]
cttgctgattgc

SEQ ID NO: 46911 - DNA, 12 bp, Artificial Sequence
  synthetic [barcode part2]
atgctcttgcgt

SEQ ID NO: 46912 - DNA, 12 bp, Artificial Sequence
  synthetic [barcode part2]
aacagagcgact

SEQ ID NO: 46913 - DNA, 12 bp, Artificial Sequence
  synthetic [barcode part2]
catggcttagta

SEQ ID NO: 46914 - DNA, 12 bp, Artificial Sequence
  synthetic [barcode part2]
agcgattacatc

SEQ ID NO: 46915 - DNA, 12 bp, Artificial Sequence
  synthetic [barcode part2]
catgctgctgga

SEQ ID NO: 46916 - DNA, 12 bp, Artificial Sequence
  synthetic [barcode part2]
ctcttccgaagt

SEQ ID NO: 46917 - DNA, 12 bp, Artificial Sequence
  synthetic [barcode part2]
aagaactagccg

SEQ ID NO: 46918 - DNA, 12 bp, Artificial Sequence
  synthetic [barcode part2]
agatatggcacg

SEQ ID NO: 46919 - DNA, 12 bp, Artificial Sequence
  synthetic [barcode part2]
aagcaattggcg

SEQ ID NO: 46920 - DNA, 12 bp, Artificial Sequence
  synthetic [barcode part2]
cgtctaatgatg

SEQ ID NO: 46921 - DNA, 12 bp, Artificial Sequence
  synthetic [barcode part2]
ctcgtcgtaact

SEQ ID NO: 46922 - DNA, 12 bp, Artificial Sequence
  synthetic [barcode part2]
catgtcgccaga

SEQ ID NO: 46923 - DNA, 12 bp, Artificial Sequence
  synthetic [barcode part2]
cttcttcagagc

SEQ ID NO: 46924 - DNA, 12 bp, Artificial Sequence
  synthetic [barcode part2]
cgtctggcaatg

SEQ ID NO: 46925 - DNA, 12 bp, Artificial Sequence
  synthetic [barcode part2]
acagcgtgagat

SEQ ID NO: 46926 - DNA, 12 bp, Artificial Sequence
  synthetic [barcode part2]
ccgtagttctca

SEQ ID NO: 46927 - DNA, 12 bp, Artificial Sequence
  synthetic [barcode part2]
actgctgacgca

SEQ ID NO: 46928 - DNA, 12 bp, Artificial Sequence
  synthetic [barcode part2]
cgctcaataaca

SEQ ID NO: 46929 - DNA, 12 bp, Artificial Sequence
  synthetic [barcode part2]
actcgtgtgata

SEQ ID NO: 46930 - DNA, 12 bp, Artificial Sequence
  synthetic [barcode part2]
atgaacttggct

SEQ ID NO: 46931 - DNA, 12 bp, Artificial Sequence
  synthetic [barcode part2]
atgccagatcat

SEQ ID NO: 46932 - DNA, 12 bp, Artificial Sequence
  synthetic [barcode part2]
ctatcggataca

SEQ ID NO: 46933 - DNA, 12 bp, Artificial Sequence
  synthetic [barcode part2]
cgtaacttgatg

SEQ ID NO: 46934 - DNA, 12 bp, Artificial Sequence
  synthetic [barcode part2]
cgatcaagaagc

SEQ ID NO: 46935 - DNA, 12 bp, Artificial Sequence
  synthetic [barcode part2]
acgcagcagttc

SEQ ID NO: 46936 - DNA, 12 bp, Artificial Sequence
  synthetic [barcode part2]
ctcatcatggct

SEQ ID NO: 46937 - DNA, 12 bp, Artificial Sequence
  synthetic [barcode part2]
actgcactggca

SEQ ID NO: 46938 - DNA, 12 bp, Artificial Sequence
  synthetic [barcode part2]
aatcagcgagac

SEQ ID NO: 46939 - DNA, 12 bp, Artificial Sequence
  synthetic [barcode part2]
cgccaatgatta

SEQ ID NO: 46940 - DNA, 12 bp, Artificial Sequence
  synthetic [barcode part2]
aagtacagcacg

SEQ ID NO: 46941 - DNA, 12 bp, Artificial Sequence
  synthetic [barcode part2]
agagctgtaacg

SEQ ID NO: 46942 - DNA, 12 bp, Artificial Sequence
  synthetic [barcode part2]
cttgcactatgc

SEQ ID NO: 46943 - DNA, 12 bp, Artificial Sequence
  synthetic [barcode part2]
actatcaacgca

SEQ ID NO: 46944 - DNA, 12 bp, Artificial Sequence
  synthetic [barcode part2]
ccactaagtgcg

SEQ ID NO: 46945 - DNA, 12 bp, Artificial Sequence
  synthetic [barcode part2]
ctgacataatcg

SEQ ID NO: 46946 - DNA, 12 bp, Artificial Sequence
  synthetic [barcode part2]
agcgtgcgattc

SEQ ID NO: 46947 - DNA, 12 bp, Artificial Sequence
  synthetic [barcode part2]
cgagcacattgc

SEQ ID NO: 46948 - DNA, 12 bp, Artificial Sequence
  synthetic [barcode part2]
ccgagttacata

SEQ ID NO: 46949 - DNA, 12 bp, Artificial Sequence
  synthetic [barcode part2]
cagtgatacatc

SEQ ID NO: 46950 - DNA, 12 bp, Artificial Sequence
  synthetic [barcode part2]
ctccatacgcat

SEQ ID NO: 46951 - DNA, 12 bp, Artificial Sequence
  synthetic [barcode part2]
ctatggcttcca

SEQ ID NO: 46952 - DNA, 12 bp, Artificial Sequence
  synthetic [barcode part2]
aagtatggcgtg

SEQ ID NO: 46953 - DNA, 12 bp, Artificial Sequence
  synthetic [barcode part2]
ctgttgagcacg

SEQ ID NO: 46954 - DNA, 12 bp, Artificial Sequence
  synthetic [barcode part2]
caatggccgtgt

SEQ ID NO: 46955 - DNA, 12 bp, Artificial Sequence
  synthetic [barcode part2]
ctagctgcttca

SEQ ID NO: 46956 - DNA, 12 bp, Artificial Sequence
  synthetic [barcode part2]
catactaagcca

SEQ ID NO: 46957 - DNA, 12 bp, Artificial Sequence
  synthetic [barcode part2]
agagtgcacatg

SEQ ID NO: 46958 - DNA, 12 bp, Artificial Sequence
  synthetic [barcode part2]
ccaagttatgtg

SEQ ID NO: 46959 - DNA, 12 bp, Artificial Sequence
  synthetic [barcode part2]
cggcatataact

SEQ ID NO: 46960 - DNA, 12 bp, Artificial Sequence
  synthetic [barcode part2]
ctgaactacgcg

SEQ ID NO: 46961 - DNA, 12 bp, Artificial Sequence
  synthetic [barcode part2]
atccacgtaaca

SEQ ID NO: 46962 - DNA, 12 bp, Artificial Sequence
  synthetic [barcode part2]
atggaagcgtgt

SEQ ID NO: 46963 - DNA, 12 bp, Artificial Sequence
  synthetic [barcode part2]
cgttcaacaatg

SEQ ID NO: 46964 - DNA, 12 bp, Artificial Sequence
  synthetic [barcode part2]
attgcgttaacg

SEQ ID NO: 46965 - DNA, 12 bp, Artificial Sequence
  synthetic [barcode part2]
atgcttcacgct

SEQ ID NO: 46966 - DNA, 12 bp, Artificial Sequence
  synthetic [barcode part2]
ctagcacggcta

SEQ ID NO: 46967 - DNA, 12 bp, Artificial Sequence
  synthetic [barcode part2]
cgcagttcagca

SEQ ID NO: 46968 - DNA, 12 bp, Artificial Sequence
  synthetic [barcode part2]
actgtatgctga

SEQ ID NO: 46969 - DNA, 12 bp, Artificial Sequence
  synthetic [barcode part2]
cgctagttcgga

SEQ ID NO: 46970 - DNA, 12 bp, Artificial Sequence
  synthetic [barcode part2]
cagcatagtcgc

SEQ ID NO: 46971 - DNA, 12 bp, Artificial Sequence
  synthetic [barcode part2]
cgcttccgtata

SEQ ID NO: 46972 - DNA, 12 bp, Artificial Sequence
  synthetic [barcode part2]
catgaagacgca

SEQ ID NO: 46973 - DNA, 12 bp, Artificial Sequence
  synthetic [barcode part2]
catagagtgcga

SEQ ID NO: 46974 - DNA, 12 bp, Artificial Sequence
  synthetic [barcode part2]
aattacactggc

SEQ ID NO: 46975 - DNA, 12 bp, Artificial Sequence
  synthetic [barcode part2]
atcacatcgaca

SEQ ID NO: 46976 - DNA, 12 bp, Artificial Sequence
  synthetic [barcode part2]
acttgatcgtga

SEQ ID NO: 46977 - DNA, 12 bp, Artificial Sequence
  synthetic [barcode part2]
agagccatagtg

SEQ ID NO: 46978 - DNA, 12 bp, Artificial Sequence
  synthetic [barcode part2]
cacgctggattg

SEQ ID NO: 46979 - DNA, 12 bp, Artificial Sequence
  synthetic [barcode part2]
agaagagcttcg

SEQ ID NO: 46980 - DNA, 12 bp, Artificial Sequence
  synthetic [barcode part2]
ccgtagtctcta

SEQ ID NO: 46981 - DNA, 12 bp, Artificial Sequence
  synthetic [barcode part2]
ccgtcaacgtga

SEQ ID NO: 46982 - DNA, 12 bp, Artificial Sequence
  synthetic [barcode part2]
ctgagccatgtg

SEQ ID NO: 46983 - DNA, 12 bp, Artificial Sequence
  synthetic [barcode part2]
agatgattggcg

SEQ ID NO: 46984 - DNA, 12 bp, Artificial Sequence
  synthetic [barcode part2]
attactagtgcg

SEQ ID NO: 46985 - DNA, 12 bp, Artificial Sequence
  synthetic [barcode part2]
cagatacattgc

SEQ ID NO: 46986 - DNA, 12 bp, Artificial Sequence
  synthetic [barcode part2]
atctaacacgca

SEQ ID NO: 46987 - DNA, 12 bp, Artificial Sequence
  synthetic [barcode part2]
acatcaatggct

SEQ ID NO: 46988 - DNA, 12 bp, Artificial Sequence
  synthetic [barcode part2]
ctgagttatacg

SEQ ID NO: 46989 - DNA, 12 bp, Artificial Sequence
  synthetic [barcode part2]
agcggcttatgc

SEQ ID NO: 46990 - DNA, 12 bp, Artificial Sequence
  synthetic [barcode part2]
ctgctctcaatg

SEQ ID NO: 46991 - DNA, 12 bp, Artificial Sequence
  synthetic [barcode part2]
ccggattacgca

SEQ ID NO: 46992 - DNA, 12 bp, Artificial Sequence
  synthetic [barcode part2]
agcgtgcttgac

SEQ ID NO: 46993 - DNA, 12 bp, Artificial Sequence
  synthetic [barcode part2]
atcacgctaaca

SEQ ID NO: 46994 - DNA, 12 bp, Artificial Sequence
  synthetic [barcode part2]
ccgtgtagatta

SEQ ID NO: 46995 - DNA, 12 bp, Artificial Sequence
  synthetic [barcode part2]
cggatgttggct

SEQ ID NO: 46996 - DNA, 12 bp, Artificial Sequence
  synthetic [barcode part2]
acactctcacgt

SEQ ID NO: 46997 - DNA, 12 bp, Artificial Sequence
  synthetic [barcode part2]
ccgatcactcta

SEQ ID NO: 46998 - DNA, 12 bp, Artificial Sequence
  synthetic [barcode part2]
cattgatccaga

SEQ ID NO: 46999 - DNA, 12 bp, Artificial Sequence
  synthetic [barcode part2]
atgccagcgact

SEQ ID NO: 47000 - DNA, 12 bp, Artificial Sequence
  synthetic [barcode part2]
acattgagccat

SEQ ID NO: 47001 - DNA, 12 bp, Artificial Sequence
  synthetic [barcode part2]
ccgcataagtta

SEQ ID NO: 47002 - DNA, 12 bp, Artificial Sequence
  synthetic [barcode part2]
cttgttagtcgc

SEQ ID NO: 47003 - DNA, 12 bp, Artificial Sequence
  synthetic [barcode part2]
caacagccgcat

SEQ ID NO: 47004 - DNA, 12 bp, Artificial Sequence
  synthetic [barcode part2]
aacaatccacgt

SEQ ID NO: 47005 - DNA, 12 bp, Artificial Sequence
  synthetic [barcode part2]
atggcacagagt

SEQ ID NO: 47006 - DNA, 12 bp, Artificial Sequence
  synthetic [barcode part2]
ccacttccaatg

SEQ ID NO: 47007 - DNA, 12 bp, Artificial Sequence
  synthetic [barcode part2]
acactaacagct

SEQ ID NO: 47008 - DNA, 12 bp, Artificial Sequence
  synthetic [barcode part2]
ctctagttggct

SEQ ID NO: 47009 - DNA, 12 bp, Artificial Sequence
  synthetic [barcode part2]
actagccgaaga

SEQ ID NO: 47010 - DNA, 12 bp, Artificial Sequence
  synthetic [barcode part2]
agaagccaatcg

SEQ ID NO: 47011 - DNA, 12 bp, Artificial Sequence
  synthetic [barcode part2]
actgaagagcca

SEQ ID NO: 47012 - DNA, 12 bp, Artificial Sequence
  synthetic [barcode part2]
atctgcgcgaca

SEQ ID NO: 47013 - DNA, 12 bp, Artificial Sequence
  synthetic [barcode part2]
cgtggctcaatg

SEQ ID NO: 47014 - DNA, 12 bp, Artificial Sequence
  synthetic [barcode part2]
agccgtgaactc

SEQ ID NO: 47015 - DNA, 12 bp, Artificial Sequence
  synthetic [barcode part2]
cagttgactctc

SEQ ID NO: 47016 - DNA, 12 bp, Artificial Sequence
  synthetic [barcode part2]
actcagcgcgta

SEQ ID NO: 47017 - DNA, 12 bp, Artificial Sequence
  synthetic [barcode part2]
cagtacagccac

SEQ ID NO: 47018 - DNA, 12 bp, Artificial Sequence
  synthetic [barcode part2]
agacgtgatacg

SEQ ID NO: 47019 - DNA, 12 bp, Artificial Sequence
  synthetic [barcode part2]
actcacgtagta

SEQ ID NO: 47020 - DNA, 12 bp, Artificial Sequence
  synthetic [barcode part2]
cgttacattccg

SEQ ID NO: 47021 - DNA, 12 bp, Artificial Sequence
  synthetic [barcode part2]
aatggctcgtgc

SEQ ID NO: 47022 - DNA, 12 bp, Artificial Sequence
  synthetic [barcode part2]
cgattagctctc

SEQ ID NO: 47023 - DNA, 12 bp, Artificial Sequence
  synthetic [barcode part2]
atacagcgattc

SEQ ID NO: 47024 - DNA, 12 bp, Artificial Sequence
  synthetic [barcode part2]
agagcgtatacg

SEQ ID NO: 47025 - DNA, 12 bp, Artificial Sequence
  synthetic [barcode part2]
acttcggctcta

SEQ ID NO: 47026 - DNA, 12 bp, Artificial Sequence
  synthetic [barcode part2]
atgtctctgcgt

SEQ ID NO: 47027 - DNA, 12 bp, Artificial Sequence
  synthetic [barcode part2]
ccggcgtaatca

SEQ ID NO: 47028 - DNA, 12 bp, Artificial Sequence
  synthetic [barcode part2]
aattgcgttagc

SEQ ID NO: 47029 - DNA, 12 bp, Artificial Sequence
  synthetic [barcode part2]
catcgacaatca

SEQ ID NO: 47030 - DNA, 12 bp, Artificial Sequence
  synthetic [barcode part2]
actacgccgaca

SEQ ID NO: 47031 - DNA, 12 bp, Artificial Sequence
  synthetic [barcode part2]
catggctcgaca

SEQ ID NO: 47032 - DNA, 12 bp, Artificial Sequence
  synthetic [barcode part2]
atgagagcgcat

SEQ ID NO: 47033 - DNA, 12 bp, Artificial Sequence
  synthetic [barcode part2]
catattgtcgga

SEQ ID NO: 47034 - DNA, 12 bp, Artificial Sequence
  synthetic [barcode part2]
aagactacagcg

SEQ ID NO: 47035 - DNA, 12 bp, Artificial Sequence
  synthetic [barcode part2]
ctagaagcagca

SEQ ID NO: 47036 - DNA, 12 bp, Artificial Sequence
  synthetic [barcode part2]
aacacgctcaat

SEQ ID NO: 47037 - DNA, 12 bp, Artificial Sequence
  synthetic [barcode part2]
caacagctatgt

SEQ ID NO: 47038 - DNA, 12 bp, Artificial Sequence
  synthetic [barcode part2]
atgagttgccat

SEQ ID NO: 47039 - DNA, 12 bp, Artificial Sequence
  synthetic [barcode part2]
cgcgttaagcca

SEQ ID NO: 47040 - DNA, 12 bp, Artificial Sequence
  synthetic [barcode part2]
ccacgcaagttg

SEQ ID NO: 47041 - DNA, 12 bp, Artificial Sequence
  synthetic [barcode part2]
ctctgatgccat

SEQ ID NO: 47042 - DNA, 12 bp, Artificial Sequence
  synthetic [barcode part2]
actgttagcaca

SEQ ID NO: 47043 - DNA, 12 bp, Artificial Sequence
  synthetic [barcode part2]
acgtgtaagagc

SEQ ID NO: 47044 - DNA, 12 bp, Artificial Sequence
  synthetic [barcode part2]
atccgcacagca

SEQ ID NO: 47045 - DNA, 12 bp, Artificial Sequence
  synthetic [barcode part2]
catctctgcaca

SEQ ID NO: 47046 - DNA, 12 bp, Artificial Sequence
  synthetic [barcode part2]
attacgccaatg

SEQ ID NO: 47047 - DNA, 12 bp, Artificial Sequence
  synthetic [barcode part2]
cgcttagtgata

SEQ ID NO: 47048 - DNA, 12 bp, Artificial Sequence
  synthetic [barcode part2]
atctgcggctga

SEQ ID NO: 47049 - DNA, 12 bp, Artificial Sequence
  synthetic [barcode part2]
aataatccgtgc

SEQ ID NO: 47050 - DNA, 12 bp, Artificial Sequence
  synthetic [barcode part2]
caatagttgcgt

SEQ ID NO: 47051 - DNA, 12 bp, Artificial Sequence
  synthetic [barcode part2]
ccgtcggatgta

SEQ ID NO: 47052 - DNA, 12 bp, Artificial Sequence
  synthetic [barcode part2]
attgctgatgtg

SEQ ID NO: 47053 - DNA, 12 bp, Artificial Sequence
  synthetic [barcode part2]
cactctcacatg

SEQ ID NO: 47054 - DNA, 12 bp, Artificial Sequence
  synthetic [barcode part2]
ctcggaacttct

SEQ ID NO: 47055 - DNA, 12 bp, Artificial Sequence
  synthetic [barcode part2]
cagcaatgtatc

SEQ ID NO: 47056 - DNA, 12 bp, Artificial Sequence
  synthetic [barcode part2]
acatcggcagct

SEQ ID NO: 47057 - DNA, 12 bp, Artificial Sequence
  synthetic [barcode part2]
agcaactcgtgc

SEQ ID NO: 47058 - DNA, 12 bp, Artificial Sequence
  synthetic [barcode part2]
ctgcgcagattg

SEQ ID NO: 47059 - DNA, 12 bp, Artificial Sequence
  synthetic [barcode part2]
cttcgacattgc

SEQ ID NO: 47060 - DNA, 12 bp, Artificial Sequence
  synthetic [barcode part2]
atcatgtcagca

SEQ ID NO: 47061 - DNA, 12 bp, Artificial Sequence
  synthetic [barcode part2]
cttctctgaagc

SEQ ID NO: 47062 - DNA, 12 bp, Artificial Sequence
  synthetic [barcode part2]
ccatacagattg

SEQ ID NO: 47063 - DNA, 12 bp, Artificial Sequence
  synthetic [barcode part2]
cattcaagctga

SEQ ID NO: 47064 - DNA, 12 bp, Artificial Sequence
  synthetic [barcode part2]
actcagccgtga

SEQ ID NO: 47065 - DNA, 12 bp, Artificial Sequence
  synthetic [barcode part2]
catgtcggatta

SEQ ID NO: 47066 - DNA, 12 bp, Artificial Sequence
  synthetic [barcode part2]
agctatgtcaac

SEQ ID NO: 47067 - DNA, 12 bp, Artificial Sequence
  synthetic [barcode part2]
aagatacgcacg

SEQ ID NO: 47068 - DNA, 12 bp, Artificial Sequence
  synthetic [barcode part2]
atccgcagtcga

SEQ ID NO: 47069 - DNA, 12 bp, Artificial Sequence
  synthetic [barcode part2]
ctattgagtgca

SEQ ID NO: 47070 - DNA, 12 bp, Artificial Sequence
  synthetic [barcode part2]
atgtagtccagt

SEQ ID NO: 47071 - DNA, 12 bp, Artificial Sequence
  synthetic [barcode part2]
cttcacgtgtac

SEQ ID NO: 47072 - DNA, 12 bp, Artificial Sequence
  synthetic [barcode part2]
cagagagtcaac

SEQ ID NO: 47073 - DNA, 12 bp, Artificial Sequence
  synthetic [barcode part2]
ccattgagcgtg

SEQ ID NO: 47074 - DNA, 12 bp, Artificial Sequence
  synthetic [barcode part2]
ccggattcacga

SEQ ID NO: 47075 - DNA, 12 bp, Artificial Sequence
  synthetic [barcode part2]
acagcacgaagt

SEQ ID NO: 47076 - DNA, 12 bp, Artificial Sequence
  synthetic [barcode part2]
acgcatagaagc

SEQ ID NO: 47077 - DNA, 12 bp, Artificial Sequence
  synthetic [barcode part2]
cagctctgattc

SEQ ID NO: 47078 - DNA, 12 bp, Artificial Sequence
  synthetic [barcode part2]
agagattggctg

SEQ ID NO: 47079 - DNA, 12 bp, Artificial Sequence
  synthetic [barcode part2]
actactacgtga

SEQ ID NO: 47080 - DNA, 12 bp, Artificial Sequence
  synthetic [barcode part2]
cgctggcgatta

SEQ ID NO: 47081 - DNA, 12 bp, Artificial Sequence
  synthetic [barcode part2]
atgctctgtgct

SEQ ID NO: 47082 - DNA, 12 bp, Artificial Sequence
  synthetic [barcode part2]
cgcgtcgttaga

SEQ ID NO: 47083 - DNA, 12 bp, Artificial Sequence
  synthetic [barcode part2]
attcagcgtgcg

SEQ ID NO: 47084 - DNA, 12 bp, Artificial Sequence
  synthetic [barcode part2]
agccaatgagac

SEQ ID NO: 47085 - DNA, 12 bp, Artificial Sequence
  synthetic [barcode part2]
ctgtacaagttg

SEQ ID NO: 47086 - DNA, 12 bp, Artificial Sequence
  synthetic [barcode part2]
cgcattgaatca

SEQ ID NO: 47087 - DNA, 12 bp, Artificial Sequence
  synthetic [barcode part2]
catgccatcgga

SEQ ID NO: 47088 - DNA, 12 bp, Artificial Sequence
  synthetic [barcode part2]
acttaacgtgca

SEQ ID NO: 47089 - DNA, 12 bp, Artificial Sequence
  synthetic [barcode part2]
ctgctaagtatg

SEQ ID NO: 47090 - DNA, 12 bp, Artificial Sequence
  synthetic [barcode part2]
ctgcacgaactg

SEQ ID NO: 47091 - DNA, 12 bp, Artificial Sequence
  synthetic [barcode part2]
agaatacgcgtg

SEQ ID NO: 47092 - DNA, 12 bp, Artificial Sequence
  synthetic [barcode part2]
caatcggcttct

SEQ ID NO: 47093 - DNA, 12 bp, Artificial Sequence
  synthetic [barcode part2]
actgccagtgca

SEQ ID NO: 47094 - DNA, 12 bp, Artificial Sequence
  synthetic [barcode part2]
acggctgctaac

SEQ ID NO: 47095 - DNA, 12 bp, Artificial Sequence
  synthetic [barcode part2]
agcgttagagac

SEQ ID NO: 47096 - DNA, 12 bp, Artificial Sequence
  synthetic [barcode part2]
atgcagctcaat

SEQ ID NO: 47097 - DNA, 12 bp, Artificial Sequence
  synthetic [barcode part2]
cgcgagagtata

SEQ ID NO: 47098 - DNA, 12 bp, Artificial Sequence
  synthetic [barcode part2]
acgcttctatgc

SEQ ID NO: 47099 - DNA, 12 bp, Artificial Sequence
  synthetic [barcode part2]
ccggattgtata

SEQ ID NO: 47100 - DNA, 12 bp, Artificial Sequence
  synthetic [barcode part2]
ctcgttagctgt

SEQ ID NO: 47101 - DNA, 12 bp, Artificial Sequence
  synthetic [barcode part2]
ccgtatgaacta

SEQ ID NO: 47102 - DNA, 12 bp, Artificial Sequence
  synthetic [barcode part2]
acttgtacgaca

SEQ ID NO: 47103 - DNA, 12 bp, Artificial Sequence
  synthetic [barcode part2]
aagtctcttccg

SEQ ID NO: 47104 - DNA, 12 bp, Artificial Sequence
  synthetic [barcode part2]
atccagctatga

SEQ ID NO: 47105 - DNA, 12 bp, Artificial Sequence
  synthetic [barcode part2]
ctacttcgctga

SEQ ID NO: 47106 - DNA, 12 bp, Artificial Sequence
  synthetic [barcode part2]
aacggctcacgt

SEQ ID NO: 47107 - DNA, 12 bp, Artificial Sequence
  synthetic [barcode part2]
agcttgacatac

SEQ ID NO: 47108 - DNA, 12 bp, Artificial Sequence
  synthetic [barcode part2]
catcgcatctca

SEQ ID NO: 47109 - DNA, 12 bp, Artificial Sequence
  synthetic [barcode part2]
acagccattgat

SEQ ID NO: 47110 - DNA, 12 bp, Artificial Sequence
  synthetic [barcode part2]
atcagagagcca

SEQ ID NO: 47111 - DNA, 12 bp, Artificial Sequence
  synthetic [barcode part2]
actacgctagta

SEQ ID NO: 47112 - DNA, 12 bp, Artificial Sequence
  synthetic [barcode part2]
ctactaacgtga

SEQ ID NO: 47113 - DNA, 12 bp, Artificial Sequence
  synthetic [barcode part2]
ccaatcattccg

SEQ ID NO: 47114 - DNA, 12 bp, Artificial Sequence
  synthetic [barcode part2]
atcggaactgga

SEQ ID NO: 47115 - DNA, 12 bp, Artificial Sequence
  synthetic [barcode part2]
caagaagccgat

SEQ ID NO: 47116 - DNA, 12 bp, Artificial Sequence
  synthetic [barcode part2]
cttgattctggc

SEQ ID NO: 47117 - DNA, 12 bp, Artificial Sequence
  synthetic [barcode part2]
ctcattgcagct

SEQ ID NO: 47118 - DNA, 12 bp, Artificial Sequence
  synthetic [barcode part2]
ccgaatcataca

SEQ ID NO: 47119 - DNA, 12 bp, Artificial Sequence
  synthetic [barcode part2]
atctatgcagca

SEQ ID NO: 47120 - DNA, 12 bp, Artificial Sequence
  synthetic [barcode part2]
ccaatacagccg

SEQ ID NO: 47121 - DNA, 12 bp, Artificial Sequence
  synthetic [barcode part2]
agcactagaagc

SEQ ID NO: 47122 - DNA, 12 bp, Artificial Sequence
  synthetic [barcode part2]
agcagttcacgc

SEQ ID NO: 47123 - DNA, 12 bp, Artificial Sequence
  synthetic [barcode part2]
cttcaatgtcgc

SEQ ID NO: 47124 - DNA, 12 bp, Artificial Sequence
  synthetic [barcode part2]
atgctggactat

SEQ ID NO: 47125 - DNA, 12 bp, Artificial Sequence
  synthetic [barcode part2]
aacttccgctgt

SEQ ID NO: 47126 - DNA, 12 bp, Artificial Sequence
  synthetic [barcode part2]
agcttccgttac

SEQ ID NO: 47127 - DNA, 12 bp, Artificial Sequence
  synthetic [barcode part2]
cgcgttagatta

SEQ ID NO: 47128 - DNA, 12 bp, Artificial Sequence
  synthetic [barcode part2]
aagtgatcagcg

SEQ ID NO: 47129 - DNA, 12 bp, Artificial Sequence
  synthetic [barcode part2]
cactcaacagcg

SEQ ID NO: 47130 - DNA, 12 bp, Artificial Sequence
  synthetic [barcode part2]
cggagttagagt

SEQ ID NO: 47131 - DNA, 12 bp, Artificial Sequence
  synthetic [barcode part2]
cttgtcgcaatc

SEQ ID NO: 47132 - DNA, 12 bp, Artificial Sequence
  synthetic [barcode part2]
cagcagcacatc

SEQ ID NO: 47133 - DNA, 12 bp, Artificial Sequence
  synthetic [barcode part2]
agcatacaactc

SEQ ID NO: 47134 - DNA, 12 bp, Artificial Sequence
  synthetic [barcode part2]
ctccacgatact

SEQ ID NO: 47135 - DNA, 12 bp, Artificial Sequence
  synthetic [barcode part2]
cagcgtgattgc

SEQ ID NO: 47136 - DNA, 12 bp, Artificial Sequence
  synthetic [barcode part2]
ccgacgcgatta

SEQ ID NO: 47137 - DNA, 12 bp, Artificial Sequence
  synthetic [barcode part2]
aagacgcacatg

SEQ ID NO: 47138 - DNA, 12 bp, Artificial Sequence
  synthetic [barcode part2]
atcgccaacgca

SEQ ID NO: 47139 - DNA, 12 bp, Artificial Sequence
  synthetic [barcode part2]
actatcacacga

SEQ ID NO: 47140 - DNA, 12 bp, Artificial Sequence
  synthetic [barcode part2]
ctactaagcgta

SEQ ID NO: 47141 - DNA, 12 bp, Artificial Sequence
  synthetic [barcode part2]
acgttagtgatc

SEQ ID NO: 47142 - DNA, 12 bp, Artificial Sequence
  synthetic [barcode part2]
ccagtgcaactg

SEQ ID NO: 47143 - DNA, 12 bp, Artificial Sequence
  synthetic [barcode part2]
caagctgcatat

SEQ ID NO: 47144 - DNA, 12 bp, Artificial Sequence
  synthetic [barcode part2]
attgttaacgcg

SEQ ID NO: 47145 - DNA, 12 bp, Artificial Sequence
  synthetic [barcode part2]
ctaacatagcca

SEQ ID NO: 47146 - DNA, 12 bp, Artificial Sequence
  synthetic [barcode part2]
cacaacttggcg

SEQ ID NO: 47147 - DNA, 12 bp, Artificial Sequence
  synthetic [barcode part2]
aacggctacgct

SEQ ID NO: 47148 - DNA, 12 bp, Artificial Sequence
  synthetic [barcode part2]
agcgcgtaactc

SEQ ID NO: 47149 - DNA, 12 bp, Artificial Sequence
  synthetic [barcode part2]
atatgcgagagc

SEQ ID NO: 47150 - DNA, 12 bp, Artificial Sequence
  synthetic [barcode part2]
ctccagctaact

SEQ ID NO: 47151 - DNA, 12 bp, Artificial Sequence
  synthetic [barcode part2]
aatcgtgctggc

SEQ ID NO: 47152 - DNA, 12 bp, Artificial Sequence
  synthetic [barcode part2]
catgtcgagcca

SEQ ID NO: 47153 - DNA, 12 bp, Artificial Sequence
  synthetic [barcode part2]
cttaactccgac

SEQ ID NO: 47154 - DNA, 12 bp, Artificial Sequence
  synthetic [barcode part2]
cttacgctgtac

SEQ ID NO: 47155 - DNA, 12 bp, Artificial Sequence
  synthetic [barcode part2]
acgtggcttgac

SEQ ID NO: 47156 - DNA, 12 bp, Artificial Sequence
  synthetic [barcode part2]
acagctgccgat

SEQ ID NO: 47157 - DNA, 12 bp, Artificial Sequence
  synthetic [barcode part2]
acttagtcacga

SEQ ID NO: 47158 - DNA, 12 bp, Artificial Sequence
  synthetic [barcode part2]
cagtagttatgc

SEQ ID NO: 47159 - DNA, 12 bp, Artificial Sequence
  synthetic [barcode part2]
cattagtggcta

SEQ ID NO: 47160 - DNA, 12 bp, Artificial Sequence
  synthetic [barcode part2]
cgcggcttaaca

SEQ ID NO: 47161 - DNA, 12 bp, Artificial Sequence
  synthetic [barcode part2]
cttgccatagtc

SEQ ID NO: 47162 - DNA, 12 bp, Artificial Sequence
  synthetic [barcode part2]
atggctgttgat

SEQ ID NO: 47163 - DNA, 12 bp, Artificial Sequence
  synthetic [barcode part2]
cggattgcatat

SEQ ID NO: 47164 - DNA, 12 bp, Artificial Sequence
  synthetic [barcode part2]
agtctggcatat

SEQ ID NO: 47165 - DNA, 12 bp, Artificial Sequence
  synthetic [barcode part2]
cagtgcgtgatc

SEQ ID NO: 47166 - DNA, 12 bp, Artificial Sequence
  synthetic [barcode part2]
cagactatgcgc

SEQ ID NO: 47167 - DNA, 12 bp, Artificial Sequence
  synthetic [barcode part2]
atccgtgtggca

SEQ ID NO: 47168 - DNA, 12 bp, Artificial Sequence
  synthetic [barcode part2]
atcatgtgtcga

SEQ ID NO: 47169 - DNA, 12 bp, Artificial Sequence
  synthetic [barcode part2]
agttggcggaat

SEQ ID NO: 47170 - DNA, 12 bp, Artificial Sequence
  synthetic [barcode part2]
agtctcttggct

SEQ ID NO: 47171 - DNA, 12 bp, Artificial Sequence
  synthetic [barcode part2]
ctcgccaactat

SEQ ID NO: 47172 - DNA, 12 bp, Artificial Sequence
  synthetic [barcode part2]
cactatgttccg

SEQ ID NO: 47173 - DNA, 12 bp, Artificial Sequence
  synthetic [barcode part2]
aactgcgctaat

SEQ ID NO: 47174 - DNA, 12 bp, Artificial Sequence
  synthetic [barcode part2]
agcaactgcgtc

SEQ ID NO: 47175 - DNA, 12 bp, Artificial Sequence
  synthetic [barcode part2]
attgtgccagcg

SEQ ID NO: 47176 - DNA, 12 bp, Artificial Sequence
  synthetic [barcode part2]
cgcggctattga

SEQ ID NO: 47177 - DNA, 12 bp, Artificial Sequence
  synthetic [barcode part2]
cagcaatcacgc

SEQ ID NO: 47178 - DNA, 12 bp, Artificial Sequence
  synthetic [barcode part2]
cgcagttgtcga

SEQ ID NO: 47179 - DNA, 12 bp, Artificial Sequence
  synthetic [barcode part2]
actatacgtcga

SEQ ID NO: 47180 - DNA, 12 bp, Artificial Sequence
  synthetic [barcode part2]
cagtatggctgc

SEQ ID NO: 47181 - DNA, 12 bp, Artificial Sequence
  synthetic [barcode part2]
aacgcacttagt

SEQ ID NO: 47182 - DNA, 12 bp, Artificial Sequence
  synthetic [barcode part2]
atatggcagttc

SEQ ID NO: 47183 - DNA, 12 bp, Artificial Sequence
  synthetic [barcode part2]
agtgccaagagt

SEQ ID NO: 47184 - DNA, 12 bp, Artificial Sequence
  synthetic [barcode part2]
ccaatgtagttg

SEQ ID NO: 47185 - DNA, 12 bp, Artificial Sequence
  synthetic [barcode part2]
ccgttagtgcga

SEQ ID NO: 47186 - DNA, 12 bp, Artificial Sequence
  synthetic [barcode part2]
agctgatgaagc

SEQ ID NO: 47187 - DNA, 12 bp, Artificial Sequence
  synthetic [barcode part2]
agcacgcttagc

SEQ ID NO: 47188 - DNA, 12 bp, Artificial Sequence
  synthetic [barcode part2]
cttacattgcgc

SEQ ID NO: 47189 - DNA, 12 bp, Artificial Sequence
  synthetic [barcode part2]
attctctagccg

SEQ ID NO: 47190 - DNA, 12 bp, Artificial Sequence
  synthetic [barcode part2]
acaagccgccat

SEQ ID NO: 47191 - DNA, 12 bp, Artificial Sequence
  synthetic [barcode part2]
catgtgcttcca

SEQ ID NO: 47192 - DNA, 12 bp, Artificial Sequence
  synthetic [barcode part2]
attgccagcgtg

SEQ ID NO: 47193 - DNA, 12 bp, Artificial Sequence
  synthetic [barcode part2]
cactcaatgatg

SEQ ID NO: 47194 - DNA, 12 bp, Artificial Sequence
  synthetic [barcode part2]
ctcgagagaagt

SEQ ID NO: 47195 - DNA, 12 bp, Artificial Sequence
  synthetic [barcode part2]
atcatcagtgca

SEQ ID NO: 47196 - DNA, 12 bp, Artificial Sequence
  synthetic [barcode part2]
cttgccaatcac

SEQ ID NO: 47197 - DNA, 12 bp, Artificial Sequence
  synthetic [barcode part2]
ataagagtgcgc

SEQ ID NO: 47198 - DNA, 12 bp, Artificial Sequence
  synthetic [barcode part2]
agctgtattagc

SEQ ID NO: 47199 - DNA, 12 bp, Artificial Sequence
  synthetic [barcode part2]
agtccagcgcat

SEQ ID NO: 47200 - DNA, 12 bp, Artificial Sequence
  synthetic [barcode part2]
cactagtagccg

SEQ ID NO: 47201 - DNA, 12 bp, Artificial Sequence
  synthetic [barcode part2]
aatcacgccagc

SEQ ID NO: 47202 - DNA, 12 bp, Artificial Sequence
  synthetic [barcode part2]
aattcaacgtgc

SEQ ID NO: 47203 - DNA, 12 bp, Artificial Sequence
  synthetic [barcode part2]
cgtctctgtatg

SEQ ID NO: 47204 - DNA, 12 bp, Artificial Sequence
  synthetic [barcode part2]
aatgcgtggctc

SEQ ID NO: 47205 - DNA, 12 bp, Artificial Sequence
  synthetic [barcode part2]
cagtgtacaatc

SEQ ID NO: 47206 - DNA, 12 bp, Artificial Sequence
  synthetic [barcode part2]
actcagcataca

SEQ ID NO: 47207 - DNA, 12 bp, Artificial Sequence
  synthetic [barcode part2]
acttagtacgca

SEQ ID NO: 47208 - DNA, 12 bp, Artificial Sequence
  synthetic [barcode part2]
ccgtatgtcgga

SEQ ID NO: 47209 - DNA, 12 bp, Artificial Sequence
  synthetic [barcode part2]
caacatagctgt

SEQ ID NO: 47210 - DNA, 12 bp, Artificial Sequence
  synthetic [barcode part2]
atagtcgccagc

SEQ ID NO: 47211 - DNA, 12 bp, Artificial Sequence
  synthetic [barcode part2]
caagtatgccat

SEQ ID NO: 47212 - DNA, 12 bp, Artificial Sequence
  synthetic [barcode part2]
cgcatactctca

SEQ ID NO: 47213 - DNA, 12 bp, Artificial Sequence
  synthetic [barcode part2]
cagattggcgtc

SEQ ID NO: 47214 - DNA, 12 bp, Artificial Sequence
  synthetic [barcode part2]
atctcggcttca

SEQ ID NO: 47215 - DNA, 12 bp, Artificial Sequence
  synthetic [barcode part2]
aatctaacgcac

SEQ ID NO: 47216 - DNA, 12 bp, Artificial Sequence
  synthetic [barcode part2]
ctacacgttaga

SEQ ID NO: 47217 - DNA, 12 bp, Artificial Sequence
  synthetic [barcode part2]
ccgaatccgtga

SEQ ID NO: 47218 - DNA, 12 bp, Artificial Sequence
  synthetic [barcode part2]
cagcgcaatcac

SEQ ID NO: 47219 - DNA, 12 bp, Artificial Sequence
  synthetic [barcode part2]
acatctccacgt

SEQ ID NO: 47220 - DNA, 12 bp, Artificial Sequence
  synthetic [barcode part2]
atctggcataca

SEQ ID NO: 47221 - DNA, 12 bp, Artificial Sequence
  synthetic [barcode part2]
agtgccagagat

SEQ ID NO: 47222 - DNA, 12 bp, Artificial Sequence
  synthetic [barcode part2]
ctgatgtagccg

SEQ ID NO: 47223 - DNA, 12 bp, Artificial Sequence
  synthetic [barcode part2]
cgagccaatgtc

SEQ ID NO: 47224 - DNA, 12 bp, Artificial Sequence
  synthetic [barcode part2]
ctacacgagtta

SEQ ID NO: 47225 - DNA, 12 bp, Artificial Sequence
  synthetic [barcode part2]
cacaatctgatg

SEQ ID NO: 47226 - DNA, 12 bp, Artificial Sequence
  synthetic [barcode part2]
aacttgacgtgt

SEQ ID NO: 47227 - DNA, 12 bp, Artificial Sequence
  synthetic [barcode part2]
acagtcgctaat

SEQ ID NO: 47228 - DNA, 12 bp, Artificial Sequence
  synthetic [barcode part2]
actcgacgtata

SEQ ID NO: 47229 - DNA, 12 bp, Artificial Sequence
  synthetic [barcode part2]
ccgtctctagta

SEQ ID NO: 47230 - DNA, 12 bp, Artificial Sequence
  synthetic [barcode part2]
agagtatacgcg

SEQ ID NO: 47231 - DNA, 12 bp, Artificial Sequence
  synthetic [barcode part2]
acaagagcgtgt

SEQ ID NO: 47232 - DNA, 12 bp, Artificial Sequence
  synthetic [barcode part2]
atcagccagaga

SEQ ID NO: 47233 - DNA, 12 bp, Artificial Sequence
  synthetic [barcode part2]
cgctacatctca

SEQ ID NO: 47234 - DNA, 12 bp, Artificial Sequence
  synthetic [barcode part2]
cactggcaactg

SEQ ID NO: 47235 - DNA, 12 bp, Artificial Sequence
  synthetic [barcode part2]
agttatgccagt

SEQ ID NO: 47236 - DNA, 12 bp, Artificial Sequence
  synthetic [barcode part2]
cagacgcgttac

SEQ ID NO: 47237 - DNA, 12 bp, Artificial Sequence
  synthetic [barcode part2]
ccggaagcaata

SEQ ID NO: 47238 - DNA, 12 bp, Artificial Sequence
  synthetic [barcode part2]
ctagcacaatca

SEQ ID NO: 47239 - DNA, 12 bp, Artificial Sequence
  synthetic [barcode part2]
agtagccgcact

SEQ ID NO: 47240 - DNA, 12 bp, Artificial Sequence
  synthetic [barcode part2]
agcgagagttac

SEQ ID NO: 47241 - DNA, 12 bp, Artificial Sequence
  synthetic [barcode part2]
ctgctggacatg

SEQ ID NO: 47242 - DNA, 12 bp, Artificial Sequence
  synthetic [barcode part2]
ctacgcactgga

SEQ ID NO: 47243 - DNA, 12 bp, Artificial Sequence
  synthetic [barcode part2]
atcatactggca

SEQ ID NO: 47244 - DNA, 12 bp, Artificial Sequence
  synthetic [barcode part2]
cgtgccagattg

SEQ ID NO: 47245 - DNA, 12 bp, Artificial Sequence
  synthetic [barcode part2]
agtctaacacgt

SEQ ID NO: 47246 - DNA, 12 bp, Artificial Sequence
  synthetic [barcode part2]
ctatgcggatta

SEQ ID NO: 47247 - DNA, 12 bp, Artificial Sequence
  synthetic [barcode part2]
acgctcttacac

SEQ ID NO: 47248 - DNA, 12 bp, Artificial Sequence
  synthetic [barcode part2]
cttacgcgtatc

SEQ ID NO: 47249 - DNA, 12 bp, Artificial Sequence
  synthetic [barcode part2]
aacagccatact

SEQ ID NO: 47250 - DNA, 12 bp, Artificial Sequence
  synthetic [barcode part2]
cggcagctacat

SEQ ID NO: 47251 - DNA, 12 bp, Artificial Sequence
  synthetic [barcode part2]
atatagtggctc

SEQ ID NO: 47252 - DNA, 12 bp, Artificial Sequence
  synthetic [barcode part2]
agcgcactcaac

SEQ ID NO: 47253 - DNA, 12 bp, Artificial Sequence
  synthetic [barcode part2]
acggaagcatac

SEQ ID NO: 47254 - DNA, 12 bp, Artificial Sequence
  synthetic [barcode part2]
acgactattagc

SEQ ID NO: 47255 - DNA, 12 bp, Artificial Sequence
  synthetic [barcode part2]
agccacgttagc

SEQ ID NO: 47256 - DNA, 12 bp, Artificial Sequence
  synthetic [barcode part2]
actgcgttgata

SEQ ID NO: 47257 - DNA, 12 bp, Artificial Sequence
  synthetic [barcode part2]
aacgcgtccagt

SEQ ID NO: 47258 - DNA, 12 bp, Artificial Sequence
  synthetic [barcode part2]
catctggcgaca

SEQ ID NO: 47259 - DNA, 12 bp, Artificial Sequence
  synthetic [barcode part2]
aattggcgaagc

SEQ ID NO: 47260 - DNA, 12 bp, Artificial Sequence
  synthetic [barcode part2]
aatgcgtctggc

SEQ ID NO: 47261 - DNA, 12 bp, Artificial Sequence
  synthetic [barcode part2]
cgacagctgtac

SEQ ID NO: 47262 - DNA, 12 bp, Artificial Sequence
  synthetic [barcode part2]
cgtgctgagttg

SEQ ID NO: 47263 - DNA, 12 bp, Artificial Sequence
  synthetic [barcode part2]
atccaatgcgta

SEQ ID NO: 47264 - DNA, 12 bp, Artificial Sequence
  synthetic [barcode part2]
ccgagagtgata

SEQ ID NO: 47265 - DNA, 12 bp, Artificial Sequence
  synthetic [barcode part2]
ctgtaacttccg

SEQ ID NO: 47266 - DNA, 12 bp, Artificial Sequence
  synthetic [barcode part2]
agtgcacttgat

SEQ ID NO: 47267 - DNA, 12 bp, Artificial Sequence
  synthetic [barcode part2]
cgtaatctggcg

SEQ ID NO: 47268 - DNA, 12 bp, Artificial Sequence
  synthetic [barcode part2]
agtgctggaagt

SEQ ID NO: 47269 - DNA, 12 bp, Artificial Sequence
  synthetic [barcode part2]
cttcagcgttac

SEQ ID NO: 47270 - DNA, 12 bp, Artificial Sequence
  synthetic [barcode part2]
cttattggctgc

SEQ ID NO: 47271 - DNA, 12 bp, Artificial Sequence
  synthetic [barcode part2]
cagatcatatgc

SEQ ID NO: 47272 - DNA, 12 bp, Artificial Sequence
  synthetic [barcode part2]
agcaatctatgc

SEQ ID NO: 47273 - DNA, 12 bp, Artificial Sequence
  synthetic [barcode part2]
cacggcttgatg

SEQ ID NO: 47274 - DNA, 12 bp, Artificial Sequence
  synthetic [barcode part2]
attcaatacgcg

SEQ ID NO: 47275 - DNA, 12 bp, Artificial Sequence
  synthetic [barcode part2]
atcgtcgtatga

SEQ ID NO: 47276 - DNA, 12 bp, Artificial Sequence
  synthetic [barcode part2]
ctgtcaagtgcg

SEQ ID NO: 47277 - DNA, 12 bp, Artificial Sequence
  synthetic [barcode part2]
atgcacgcttct

SEQ ID NO: 47278 - DNA, 12 bp, Artificial Sequence
  synthetic [barcode part2]
cgccgacaacta

SEQ ID NO: 47279 - DNA, 12 bp, Artificial Sequence
  synthetic [barcode part2]
atacgcactctc

SEQ ID NO: 47280 - DNA, 12 bp, Artificial Sequence
  synthetic [barcode part2]
cataatccgaca

SEQ ID NO: 47281 - DNA, 12 bp, Artificial Sequence
  synthetic [barcode part2]
attcacgcaatg

SEQ ID NO: 47282 - DNA, 12 bp, Artificial Sequence
  synthetic [barcode part2]
atccgacacata

SEQ ID NO: 47283 - DNA, 12 bp, Artificial Sequence
  synthetic [barcode part2]
catccgatggca

SEQ ID NO: 47284 - DNA, 12 bp, Artificial Sequence
  synthetic [barcode part2]
aagtgtagtgcg

SEQ ID NO: 47285 - DNA, 12 bp, Artificial Sequence
  synthetic [barcode part2]
cgttgataactg

SEQ ID NO: 47286 - DNA, 12 bp, Artificial Sequence
  synthetic [barcode part2]
agcgaagtgatc

SEQ ID NO: 47287 - DNA, 12 bp, Artificial Sequence
  synthetic [barcode part2]
ctatcaagcaca

SEQ ID NO: 47288 - DNA, 12 bp, Artificial Sequence
  synthetic [barcode part2]
atcgtgctagta

SEQ ID NO: 47289 - DNA, 12 bp, Artificial Sequence
  synthetic [barcode part2]
agtgtgcaatct

SEQ ID NO: 47290 - DNA, 12 bp, Artificial Sequence
  synthetic [barcode part2]
atccatacgaca

SEQ ID NO: 47291 - DNA, 12 bp, Artificial Sequence
  synthetic [barcode part2]
cttcgcaatgtc

SEQ ID NO: 47292 - DNA, 12 bp, Artificial Sequence
  synthetic [barcode part2]
cagcagccatac

SEQ ID NO: 47293 - DNA, 12 bp, Artificial Sequence
  synthetic [barcode part2]
caatgcggctgt

SEQ ID NO: 47294 - DNA, 12 bp, Artificial Sequence
  synthetic [barcode part2]
ctctggcatcat

SEQ ID NO: 47295 - DNA, 12 bp, Artificial Sequence
  synthetic [barcode part2]
atgagccgctgt

SEQ ID NO: 47296 - DNA, 12 bp, Artificial Sequence
  synthetic [barcode part2]
agcatgtctggc

SEQ ID NO: 47297 - DNA, 12 bp, Artificial Sequence
  synthetic [barcode part2]
actgtgcattga

SEQ ID NO: 47298 - DNA, 12 bp, Artificial Sequence
  synthetic [barcode part2]
acagattgccat

SEQ ID NO: 47299 - DNA, 12 bp, Artificial Sequence
  synthetic [barcode part2]
atcagagccaga

SEQ ID NO: 47300 - DNA, 12 bp, Artificial Sequence
  synthetic [barcode part2]
atcgttagcgta

SEQ ID NO: 47301 - DNA, 12 bp, Artificial Sequence
  synthetic [barcode part2]
cggaacttctct

SEQ ID NO: 47302 - DNA, 12 bp, Artificial Sequence
  synthetic [barcode part2]
caagtgcatcat

SEQ ID NO: 47303 - DNA, 12 bp, Artificial Sequence
  synthetic [barcode part2]
cggcatagccat

SEQ ID NO: 47304 - DNA, 12 bp, Artificial Sequence
  synthetic [barcode part2]
ccgctcttagta

SEQ ID NO: 47305 - DNA, 12 bp, Artificial Sequence
  synthetic [barcode part2]
atctggccgtga

SEQ ID NO: 47306 - DNA, 12 bp, Artificial Sequence
  synthetic [barcode part2]
ctcgtatcgtgt

SEQ ID NO: 47307 - DNA, 12 bp, Artificial Sequence
  synthetic [barcode part2]
acttaactgcga

SEQ ID NO: 47308 - DNA, 12 bp, Artificial Sequence
  synthetic [barcode part2]
ctgtatggattg

SEQ ID NO: 47309 - DNA, 12 bp, Artificial Sequence
  synthetic [barcode part2]
ctaagttcacga

SEQ ID NO: 47310 - DNA, 12 bp, Artificial Sequence
  synthetic [barcode part2]
ccatatgagttg

SEQ ID NO: 47311 - DNA, 12 bp, Artificial Sequence
  synthetic [barcode part2]
acagctgttagt

SEQ ID NO: 47312 - DNA, 12 bp, Artificial Sequence
  synthetic [barcode part2]
acttatgtggca

SEQ ID NO: 47313 - DNA, 12 bp, Artificial Sequence
  synthetic [barcode part2]
ccgatcatctca

SEQ ID NO: 47314 - DNA, 12 bp, Artificial Sequence
  synthetic [barcode part2]
catgattgtcga

SEQ ID NO: 47315 - DNA, 12 bp, Artificial Sequence
  synthetic [barcode part2]
ctgcaatctctg

SEQ ID NO: 47316 - DNA, 12 bp, Artificial Sequence
  synthetic [barcode part2]
atagagatgcgc

SEQ ID NO: 47317 - DNA, 12 bp, Artificial Sequence
  synthetic [barcode part2]
caacgtgtggct

SEQ ID NO: 47318 - DNA, 12 bp, Artificial Sequence
  synthetic [barcode part2]
aagacatacgcg

SEQ ID NO: 47319 - DNA, 12 bp, Artificial Sequence
  synthetic [barcode part2]
ctacataagcca

SEQ ID NO: 47320 - DNA, 12 bp, Artificial Sequence
  synthetic [barcode part2]
cagatgttagtc

SEQ ID NO: 47321 - DNA, 12 bp, Artificial Sequence
  synthetic [barcode part2]
cgatctcttagc

SEQ ID NO: 47322 - DNA, 12 bp, Artificial Sequence
  synthetic [barcode part2]
cacacatctctg

SEQ ID NO: 47323 - DNA, 12 bp, Artificial Sequence
  synthetic [barcode part2]
ctccgcacatat

SEQ ID NO: 47324 - DNA, 12 bp, Artificial Sequence
  synthetic [barcode part2]
agcacgcagttc

SEQ ID NO: 47325 - DNA, 12 bp, Artificial Sequence
  synthetic [barcode part2]
agcatgtggctc

SEQ ID NO: 47326 - DNA, 12 bp, Artificial Sequence
  synthetic [barcode part2]
cgtaactcagcg

SEQ ID NO: 47327 - DNA, 12 bp, Artificial Sequence
  synthetic [barcode part2]
atcgtgccgaca

SEQ ID NO: 47328 - DNA, 12 bp, Artificial Sequence
  synthetic [barcode part2]
ctcagttccgat

SEQ ID NO: 47329 - DNA, 12 bp, Artificial Sequence
  synthetic [barcode part2]
atagtgcagagc

SEQ ID NO: 47330 - DNA, 12 bp, Artificial Sequence
  synthetic [barcode part2]
aatgtatccagc

SEQ ID NO: 47331 - DNA, 12 bp, Artificial Sequence
  synthetic [barcode part2]
ctggattatgtg

SEQ ID NO: 47332 - DNA, 12 bp, Artificial Sequence
  synthetic [barcode part2]
cgtgaagatgtg

SEQ ID NO: 47333 - DNA, 12 bp, Artificial Sequence
  synthetic [barcode part2]
ctcacgctacat

SEQ ID NO: 47334 - DNA, 12 bp, Artificial Sequence
  synthetic [barcode part2]
atccatagctga

SEQ ID NO: 47335 - DNA, 12 bp, Artificial Sequence
  synthetic [barcode part2]
agacagccaatg

SEQ ID NO: 47336 - DNA, 12 bp, Artificial Sequence
  synthetic [barcode part2]
actgctgcacga

SEQ ID NO: 47337 - DNA, 12 bp, Artificial Sequence
  synthetic [barcode part2]
catcagcagcca

SEQ ID NO: 47338 - DNA, 12 bp, Artificial Sequence
  synthetic [barcode part2]
actctggcttca

SEQ ID NO: 47339 - DNA, 12 bp, Artificial Sequence
  synthetic [barcode part2]
caagccacacgt

SEQ ID NO: 47340 - DNA, 12 bp, Artificial Sequence
  synthetic [barcode part2]
ctccacgtacat

SEQ ID NO: 47341 - DNA, 12 bp, Artificial Sequence
  synthetic [barcode part2]
caagcacgtcgt

SEQ ID NO: 47342 - DNA, 12 bp, Artificial Sequence
  synthetic [barcode part2]
ctagcgtaacta

SEQ ID NO: 47343 - DNA, 12 bp, Artificial Sequence
  synthetic [barcode part2]
atggccattagt

SEQ ID NO: 47344 - DNA, 12 bp, Artificial Sequence
  synthetic [barcode part2]
cttcatatgcgc

SEQ ID NO: 47345 - DNA, 12 bp, Artificial Sequence
  synthetic [barcode part2]
cattagtctgga

SEQ ID NO: 47346 - DNA, 12 bp, Artificial Sequence
  synthetic [barcode part2]
cagatacgccac

SEQ ID NO: 47347 - DNA, 12 bp, Artificial Sequence
  synthetic [barcode part2]
atcgctgacata

SEQ ID NO: 47348 - DNA, 12 bp, Artificial Sequence
  synthetic [barcode part2]
ctcacatcgcat

SEQ ID NO: 47349 - DNA, 12 bp, Artificial Sequence
  synthetic [barcode part2]
agttgcgtcaat

SEQ ID NO: 47350 - DNA, 12 bp, Artificial Sequence
  synthetic [barcode part2]
cggacattaact

SEQ ID NO: 47351 - DNA, 12 bp, Artificial Sequence
  synthetic [barcode part2]
ctgtgcgaatcg

SEQ ID NO: 47352 - DNA, 12 bp, Artificial Sequence
  synthetic [barcode part2]
ctgtgatcttcg

SEQ ID NO: 47353 - DNA, 12 bp, Artificial Sequence
  synthetic [barcode part2]
cgtggaagtatg

SEQ ID NO: 47354 - DNA, 12 bp, Artificial Sequence
  synthetic [barcode part2]
cagcgactatgc

SEQ ID NO: 47355 - DNA, 12 bp, Artificial Sequence
  synthetic [barcode part2]
acattagcgact

SEQ ID NO: 47356 - DNA, 12 bp, Artificial Sequence
  synthetic [barcode part2]
acgattgctggc

SEQ ID NO: 47357 - DNA, 12 bp, Artificial Sequence
  synthetic [barcode part2]
ccgattgcttca

SEQ ID NO: 47358 - DNA, 12 bp, Artificial Sequence
  synthetic [barcode part2]
cagtctcttgac

SEQ ID NO: 47359 - DNA, 12 bp, Artificial Sequence
  synthetic [barcode part2]
ctccgacgttat

SEQ ID NO: 47360 - DNA, 12 bp, Artificial Sequence
  synthetic [barcode part2]
ctacttccgaca

SEQ ID NO: 47361 - DNA, 12 bp, Artificial Sequence
  synthetic [barcode part2]
cggaactggaat

SEQ ID NO: 47362 - DNA, 12 bp, Artificial Sequence
  synthetic [barcode part2]
acggaagacatc

SEQ ID NO: 47363 - DNA, 12 bp, Artificial Sequence
  synthetic [barcode part2]
cactagtgattg

SEQ ID NO: 47364 - DNA, 12 bp, Artificial Sequence
  synthetic [barcode part2]
cgagctgtacac

SEQ ID NO: 47365 - DNA, 12 bp, Artificial Sequence
  synthetic [barcode part2]
cagcgacatgtc

SEQ ID NO: 47366 - DNA, 12 bp, Artificial Sequence
  synthetic [barcode part2]
cggatacactat

SEQ ID NO: 47367 - DNA, 12 bp, Artificial Sequence
  synthetic [barcode part2]
agcgtatccgac

SEQ ID NO: 47368 - DNA, 12 bp, Artificial Sequence
  synthetic [barcode part2]
agaacgcgtatg

SEQ ID NO: 47369 - DNA, 12 bp, Artificial Sequence
  synthetic [barcode part2]
ctatcggcgtga

SEQ ID NO: 47370 - DNA, 12 bp, Artificial Sequence
  synthetic [barcode part2]
cacatcagattg

SEQ ID NO: 47371 - DNA, 12 bp, Artificial Sequence
  synthetic [barcode part2]
cagacatactac

SEQ ID NO: 47372 - DNA, 12 bp, Artificial Sequence
  synthetic [barcode part2]
cgtcttcacatg

SEQ ID NO: 47373 - DNA, 12 bp, Artificial Sequence
  synthetic [barcode part2]
actgcgtgtcga

SEQ ID NO: 47374 - DNA, 12 bp, Artificial Sequence
  synthetic [barcode part2]
cagtaactacac

SEQ ID NO: 47375 - DNA, 12 bp, Artificial Sequence
  synthetic [barcode part2]
ccatctctgatg

SEQ ID NO: 47376 - DNA, 12 bp, Artificial Sequence
  synthetic [barcode part2]
ctccaatcgact

SEQ ID NO: 47377 - DNA, 12 bp, Artificial Sequence
  synthetic [barcode part2]
cagacattgatc

SEQ ID NO: 47378 - DNA, 12 bp, Artificial Sequence
  synthetic [barcode part2]
ctcgcgttgtat

SEQ ID NO: 47379 - DNA, 12 bp, Artificial Sequence
  synthetic [barcode part2]
atgccgagccat

SEQ ID NO: 47380 - DNA, 12 bp, Artificial Sequence
  synthetic [barcode part2]
atcggcttctca

SEQ ID NO: 47381 - DNA, 12 bp, Artificial Sequence
  synthetic [barcode part2]
ccgaactatgta

SEQ ID NO: 47382 - DNA, 12 bp, Artificial Sequence
  synthetic [barcode part2]
ccgatacaatca

SEQ ID NO: 47383 - DNA, 12 bp, Artificial Sequence
  synthetic [barcode part2]
atcgctgtgcga

SEQ ID NO: 47384 - DNA, 12 bp, Artificial Sequence
  synthetic [barcode part2]
catcttcgcgta

SEQ ID NO: 47385 - DNA, 12 bp, Artificial Sequence
  synthetic [barcode part2]
ctggcacgattg

SEQ ID NO: 47386 - DNA, 12 bp, Artificial Sequence
  synthetic [barcode part2]
actctcttcgga

SEQ ID NO: 47387 - DNA, 12 bp, Artificial Sequence
  synthetic [barcode part2]
ctacagcgaaga

SEQ ID NO: 47388 - DNA, 12 bp, Artificial Sequence
  synthetic [barcode part2]
cttcgtgtacac

SEQ ID NO: 47389 - DNA, 12 bp, Artificial Sequence
  synthetic [barcode part2]
ccgagccgtata

SEQ ID NO: 47390 - DNA, 12 bp, Artificial Sequence
  synthetic [barcode part2]
ctcggctaatct

SEQ ID NO: 47391 - DNA, 12 bp, Artificial Sequence
  synthetic [barcode part2]
ctcgtcgattgt

SEQ ID NO: 47392 - DNA, 12 bp, Artificial Sequence
  synthetic [barcode part2]
atccgactgcga

SEQ ID NO: 47393 - DNA, 12 bp, Artificial Sequence
  synthetic [barcode part2]
acacttcgtgct

SEQ ID NO: 47394 - DNA, 12 bp, Artificial Sequence
  synthetic [barcode part2]
atcattgcacga

SEQ ID NO: 47395 - DNA, 12 bp, Artificial Sequence
  synthetic [barcode part2]
cgcgattcaata

SEQ ID NO: 47396 - DNA, 12 bp, Artificial Sequence
  synthetic [barcode part2]
ctgaatcgtgcg

SEQ ID NO: 47397 - DNA, 12 bp, Artificial Sequence
  synthetic [barcode part2]
ctgactacttcg

SEQ ID NO: 47398 - DNA, 12 bp, Artificial Sequence
  synthetic [barcode part2]
actattgtgcga

SEQ ID NO: 47399 - DNA, 12 bp, Artificial Sequence
  synthetic [barcode part2]
catagccgtcga

SEQ ID NO: 47400 - DNA, 12 bp, Artificial Sequence
  synthetic [barcode part2]
cggcacgatcat

SEQ ID NO: 47401 - DNA, 12 bp, Artificial Sequence
  synthetic [barcode part2]
atcgttacgtga

SEQ ID NO: 47402 - DNA, 12 bp, Artificial Sequence
  synthetic [barcode part2]
aatacgcgattc

SEQ ID NO: 47403 - DNA, 12 bp, Artificial Sequence
  synthetic [barcode part2]
agtccgacgtgt

SEQ ID NO: 47404 - DNA, 12 bp, Artificial Sequence
  synthetic [barcode part2]
cggatacgtcgt

SEQ ID NO: 47405 - DNA, 12 bp, Artificial Sequence
  synthetic [barcode part2]
actccgattcca

SEQ ID NO: 47406 - DNA, 12 bp, Artificial Sequence
  synthetic [barcode part2]
ctcgtgctatgt

SEQ ID NO: 47407 - DNA, 12 bp, Artificial Sequence
  synthetic [barcode part2]
cgaacatcaatc

SEQ ID NO: 47408 - DNA, 12 bp, Artificial Sequence
  synthetic [barcode part2]
cgagcgttagtc

SEQ ID NO: 47409 - DNA, 12 bp, Artificial Sequence
  synthetic [barcode part2]
ccgccgaacata

SEQ ID NO: 47410 - DNA, 12 bp, Artificial Sequence
  synthetic [barcode part2]
caacgacgtgct

SEQ ID NO: 47411 - DNA, 12 bp, Artificial Sequence
  synthetic [barcode part2]
atccaatcgtga

SEQ ID NO: 47412 - DNA, 12 bp, Artificial Sequence
  synthetic [barcode part2]
aacgattcgtgt

SEQ ID NO: 47413 - DNA, 12 bp, Artificial Sequence
  synthetic [barcode part2]
cacttgacgacg

SEQ ID NO: 47414 - DNA, 12 bp, Artificial Sequence
  synthetic [barcode part2]
ctctcggctaat

SEQ ID NO: 47415 - DNA, 12 bp, Artificial Sequence
  synthetic [barcode part2]
attcgcacgacg

SEQ ID NO: 47416 - DNA, 12 bp, Artificial Sequence
  synthetic [barcode part2]
ccatgattctcg

SEQ ID NO: 47417 - DNA, 12 bp, Artificial Sequence
  synthetic [barcode part2]
ctcgattccagt

SEQ ID NO: 47418 - DNA, 12 bp, Artificial Sequence
  synthetic [barcode part2]
caagtcgtatgt

SEQ ID NO: 47419 - DNA, 12 bp, Artificial Sequence
  synthetic [barcode part2]
agcgaagactac

SEQ ID NO: 47420 - DNA, 12 bp, Artificial Sequence
  synthetic [barcode part2]
ctagcgttcgga

SEQ ID NO: 47421 - DNA, 12 bp, Artificial Sequence
  synthetic [barcode part2]
cgatgatgtatc

SEQ ID NO: 47422 - DNA, 12 bp, Artificial Sequence
  synthetic [barcode part2]
cgaactagtatc

SEQ ID NO: 47423 - DNA, 12 bp, Artificial Sequence
  synthetic [barcode part2]
cattaactcgga

SEQ ID NO: 47424 - DNA, 12 bp, Artificial Sequence
  synthetic [barcode part2]
agctacatcggc

SEQ ID NO: 47425 - DNA, 12 bp, Artificial Sequence
  synthetic [barcode part2]
atcgcacgtcga

SEQ ID NO: 47426 - DNA, 12 bp, Artificial Sequence
  synthetic [barcode part2]
ccagttacttcg

SEQ ID NO: 47427 - DNA, 12 bp, Artificial Sequence
  synthetic [barcode part2]
actcgcacaata

SEQ ID NO: 47428 - DNA, 12 bp, Artificial Sequence
  synthetic [barcode part2]
aagcacgacatg

SEQ ID NO: 47429 - DNA, 12 bp, Artificial Sequence
  synthetic [barcode part2]
cgaattgatgtc

SEQ ID NO: 47430 - DNA, 12 bp, Artificial Sequence
  synthetic [barcode part2]
aacgtcgtctct

SEQ ID NO: 47431 - DNA, 12 bp, Artificial Sequence
  synthetic [barcode part2]
aattgcgccgac

SEQ ID NO: 47432 - DNA, 12 bp, Artificial Sequence
  synthetic [barcode part2]
acgacatgaagc

SEQ ID NO: 47433 - DNA, 12 bp, Artificial Sequence
  synthetic [barcode part2]
agtgcgtccgat

SEQ ID NO: 47434 - DNA, 12 bp, Artificial Sequence
  synthetic [barcode part2]
cgtcgacagttg

SEQ ID NO: 47435 - DNA, 12 bp, Artificial Sequence
  synthetic [barcode part2]
aatccgacatac

SEQ ID NO: 47436 - DNA, 12 bp, Artificial Sequence
  synthetic [barcode part2]
cgatacatagtc

SEQ ID NO: 47437 - DNA, 12 bp, Artificial Sequence
  synthetic [barcode part2]
catcgtgcttca

SEQ ID NO: 47438 - DNA, 12 bp, Artificial Sequence
  synthetic [barcode part2]
cgatacagctgc

SEQ ID NO: 47439 - DNA, 12 bp, Artificial Sequence
  synthetic [barcode part2]
aagcgactagtg

SEQ ID NO: 47440 - DNA, 12 bp, Artificial Sequence
  synthetic [barcode part2]
ccgtgcgagtta

SEQ ID NO: 47441 - DNA, 12 bp, Artificial Sequence
  synthetic [barcode part2]
aatcgcatcggc

SEQ ID NO: 47442 - DNA, 12 bp, Artificial Sequence
  synthetic [barcode part2]
actcttcggcta

SEQ ID NO: 47443 - DNA, 12 bp, Artificial Sequence
  synthetic [barcode part2]
ccgatgttcgga

SEQ ID NO: 47444 - DNA, 12 bp, Artificial Sequence
  synthetic [barcode part2]
atccacgattga

SEQ ID NO: 47445 - DNA, 12 bp, Artificial Sequence
  synthetic [barcode part2]
atataactcggc

SEQ ID NO: 47446 - DNA, 12 bp, Artificial Sequence
  synthetic [barcode part2]
aatgtcgagagc

SEQ ID NO: 47447 - DNA, 12 bp, Artificial Sequence
  synthetic [barcode part2]
actgccatgcga

SEQ ID NO: 47448 - DNA, 12 bp, Artificial Sequence
  synthetic [barcode part2]
agcgagacaatc

SEQ ID NO: 47449 - DNA, 12 bp, Artificial Sequence
  synthetic [barcode part2]
ctaatactcgga

SEQ ID NO: 47450 - DNA, 12 bp, Artificial Sequence
  synthetic [barcode part2]
attcgcatagtg

SEQ ID NO: 47451 - DNA, 12 bp, Artificial Sequence
  synthetic [barcode part2]
atagccatcggc

SEQ ID NO: 47452 - DNA, 12 bp, Artificial Sequence
  synthetic [barcode part2]
cacgaagatacg

SEQ ID NO: 47453 - DNA, 12 bp, Artificial Sequence
  synthetic [barcode part2]
ctcgttacgact

SEQ ID NO: 47454 - DNA, 12 bp, Artificial Sequence
  synthetic [barcode part2]
agttcggacgct

SEQ ID NO: 47455 - DNA, 12 bp, Artificial Sequence
  synthetic [barcode part2]
cgacagcgtatc

SEQ ID NO: 47456 - DNA, 12 bp, Artificial Sequence
  synthetic [barcode part2]
cgacttcttgac

SEQ ID NO: 47457 - DNA, 12 bp, Artificial Sequence
  synthetic [barcode part2]
acttgcgattga

SEQ ID NO: 47458 - DNA, 12 bp, Artificial Sequence
  synthetic [barcode part2]
catacgcgaaga

SEQ ID NO: 47459 - DNA, 12 bp, Artificial Sequence
  synthetic [barcode part2]
atgtctcgtgct

SEQ ID NO: 47460 - DNA, 12 bp, Artificial Sequence
  synthetic [barcode part2]
cgagcgtatcac

SEQ ID NO: 47461 - DNA, 12 bp, Artificial Sequence
  synthetic [barcode part2]
cattcggattga

SEQ ID NO: 47462 - DNA, 12 bp, Artificial Sequence
  synthetic [barcode part2]
acgactaagttc

SEQ ID NO: 47463 - DNA, 12 bp, Artificial Sequence
  synthetic [barcode part2]
atcatcatgcga

SEQ ID NO: 47464 - DNA, 12 bp, Artificial Sequence
  synthetic [barcode part2]
atattgagtcgc

SEQ ID NO: 47465 - DNA, 12 bp, Artificial Sequence
  synthetic [barcode part2]
actcgacacgca

SEQ ID NO: 47466 - DNA, 12 bp, Artificial Sequence
  synthetic [barcode part2]
cgttggcaatcg

SEQ ID NO: 47467 - DNA, 12 bp, Artificial Sequence
  synthetic [barcode part2]
caacacgattgt

SEQ ID NO: 47468 - DNA, 12 bp, Artificial Sequence
  synthetic [barcode part2]
agccacgagttc

SEQ ID NO: 47469 - DNA, 12 bp, Artificial Sequence
  synthetic [barcode part2]
acgattgtcaac

SEQ ID NO: 47470 - DNA, 12 bp, Artificial Sequence
  synthetic [barcode part2]
cgaagagctaac

SEQ ID NO: 47471 - DNA, 12 bp, Artificial Sequence
  synthetic [barcode part2]
cattctcgcaca

SEQ ID NO: 47472 - DNA, 12 bp, Artificial Sequence
  synthetic [barcode part2]
cgaatacatcac

SEQ ID NO: 47473 - DNA, 12 bp, Artificial Sequence
  synthetic [barcode part2]
catgaagcacga

SEQ ID NO: 47474 - DNA, 12 bp, Artificial Sequence
  synthetic [barcode part2]
atcgcgttggca

SEQ ID NO: 47475 - DNA, 12 bp, Artificial Sequence
  synthetic [barcode part2]
aagatcacgacg

SEQ ID NO: 47476 - DNA, 12 bp, Artificial Sequence
  synthetic [barcode part2]
ctattgatgcga

SEQ ID NO: 47477 - DNA, 12 bp, Artificial Sequence
  synthetic [barcode part2]
cgcgtcgagtta

SEQ ID NO: 47478 - DNA, 12 bp, Artificial Sequence
  synthetic [barcode part2]
cgagaagtcaac

SEQ ID NO: 47479 - DNA, 12 bp, Artificial Sequence
  synthetic [barcode part2]
actggaatcgga

SEQ ID NO: 47480 - DNA, 12 bp, Artificial Sequence
  synthetic [barcode part2]
attcgacatgtg

SEQ ID NO: 47481 - DNA, 12 bp, Artificial Sequence
  synthetic [barcode part2]
cgttaacgattg

SEQ ID NO: 47482 - DNA, 12 bp, Artificial Sequence
  synthetic [barcode part2]
acgagttgtcgc

SEQ ID NO: 47483 - DNA, 12 bp, Artificial Sequence
  synthetic [barcode part2]
cgcaactcgaca

SEQ ID NO: 47484 - DNA, 12 bp, Artificial Sequence
  synthetic [barcode part2]
cgatagtgcgtc

SEQ ID NO: 47485 - DNA, 12 bp, Artificial Sequence
  synthetic [barcode part2]
aattcggatgtc

SEQ ID NO: 47486 - DNA, 12 bp, Artificial Sequence
  synthetic [barcode part2]
acaagttcgact

SEQ ID NO: 47487 - DNA, 12 bp, Artificial Sequence
  synthetic [barcode part2]
ctattagcacga

SEQ ID NO: 47488 - DNA, 12 bp, Artificial Sequence
  synthetic [barcode part2]
ccgaactgcaca

SEQ ID NO: 47489 - DNA, 12 bp, Artificial Sequence
  synthetic [barcode part2]
acgaatcattgc

SEQ ID NO: 47490 - DNA, 12 bp, Artificial Sequence
  synthetic [barcode part2]
aacagttcgcat

SEQ ID NO: 47491 - DNA, 12 bp, Artificial Sequence
  synthetic [barcode part2]
catcgacggcta

SEQ ID NO: 47492 - DNA, 12 bp, Artificial Sequence
  synthetic [barcode part2]
atcgagaagcca

SEQ ID NO: 47493 - DNA, 12 bp, Artificial Sequence
  synthetic [barcode part2]
cttccgactaac

SEQ ID NO: 47494 - DNA, 12 bp, Artificial Sequence
  synthetic [barcode part2]
atgaatcgtcgt

SEQ ID NO: 47495 - DNA, 12 bp, Artificial Sequence
  synthetic [barcode part2]
ccgatacggcta

SEQ ID NO: 47496 - DNA, 12 bp, Artificial Sequence
  synthetic [barcode part2]
aatcgcactaac

SEQ ID NO: 47497 - DNA, 12 bp, Artificial Sequence
  synthetic [barcode part2]
acttacagtcga

SEQ ID NO: 47498 - DNA, 12 bp, Artificial Sequence
  synthetic [barcode part2]
catgagatgcga

SEQ ID NO: 47499 - DNA, 12 bp, Artificial Sequence
  synthetic [barcode part2]
agttgcgaatct

SEQ ID NO: 47500 - DNA, 12 bp, Artificial Sequence
  synthetic [barcode part2]
atgattgccgat

SEQ ID NO: 47501 - DNA, 12 bp, Artificial Sequence
  synthetic [barcode part2]
ctagtcggaaga

SEQ ID NO: 47502 - DNA, 12 bp, Artificial Sequence
  synthetic [barcode part2]
cataatcgctga

SEQ ID NO: 47503 - DNA, 12 bp, Artificial Sequence
  synthetic [barcode part2]
atactctcgcac

SEQ ID NO: 47504 - DNA, 12 bp, Artificial Sequence
  synthetic [barcode part2]
cgagtcgtgtac

SEQ ID NO: 47505 - DNA, 12 bp, Artificial Sequence
  synthetic [barcode part2]
agatgcgacatg

SEQ ID NO: 47506 - DNA, 12 bp, Artificial Sequence
  synthetic [barcode part2]
caacgactgcgt

SEQ ID NO: 47507 - DNA, 12 bp, Artificial Sequence
  synthetic [barcode part2]
agcgattcatac

SEQ ID NO: 47508 - DNA, 12 bp, Artificial Sequence
  synthetic [barcode part2]
cattcaacgaca

SEQ ID NO: 47509 - DNA, 12 bp, Artificial Sequence
  synthetic [barcode part2]
atcgcactgata

SEQ ID NO: 47510 - DNA, 12 bp, Artificial Sequence
  synthetic [barcode part2]
atcgtcgatgta

SEQ ID NO: 47511 - DNA, 12 bp, Artificial Sequence
  synthetic [barcode part2]
ctatgcgagcca

SEQ ID NO: 47512 - DNA, 12 bp, Artificial Sequence
  synthetic [barcode part2]
agtgtcgcttct

SEQ ID NO: 47513 - DNA, 12 bp, Artificial Sequence
  synthetic [barcode part2]
ataattgtcggc

SEQ ID NO: 47514 - DNA, 12 bp, Artificial Sequence
  synthetic [barcode part2]
catcagcgatta

SEQ ID NO: 47515 - DNA, 12 bp, Artificial Sequence
  synthetic [barcode part2]
acgtgatccgac

SEQ ID NO: 47516 - DNA, 12 bp, Artificial Sequence
  synthetic [barcode part2]
atctctcggcta

SEQ ID NO: 47517 - DNA, 12 bp, Artificial Sequence
  synthetic [barcode part2]
cgatagtcgtgc

SEQ ID NO: 47518 - DNA, 12 bp, Artificial Sequence
  synthetic [barcode part2]
cgaatcatacac

SEQ ID NO: 47519 - DNA, 12 bp, Artificial Sequence
  synthetic [barcode part2]
ataacgcgaagc

SEQ ID NO: 47520 - DNA, 12 bp, Artificial Sequence
  synthetic [barcode part2]
aatcacgttgac

SEQ ID NO: 47521 - DNA, 12 bp, Artificial Sequence
  synthetic [barcode part2]
cgtaatccaatg

SEQ ID NO: 47522 - DNA, 12 bp, Artificial Sequence
  synthetic [barcode part2]
ccgttgacacga

SEQ ID NO: 47523 - DNA, 12 bp, Artificial Sequence
  synthetic [barcode part2]
ccaagagtagtg

SEQ ID NO: 47524 - DNA, 12 bp, Artificial Sequence
  synthetic [barcode part2]
cgtgtcgaactg

SEQ ID NO: 47525 - DNA, 12 bp, Artificial Sequence
  synthetic [barcode part2]
agtgaagcgact

SEQ ID NO: 47526 - DNA, 12 bp, Artificial Sequence
  synthetic [barcode part2]
acgtagtctaac

SEQ ID NO: 47527 - DNA, 12 bp, Artificial Sequence
  synthetic [barcode part2]
cacgccaagttg

SEQ ID NO: 47528 - DNA, 12 bp, Artificial Sequence
  synthetic [barcode part2]
acgaactgctgc

SEQ ID NO: 47529 - DNA, 12 bp, Artificial Sequence
  synthetic [barcode part2]
aatgcgttcaac

SEQ ID NO: 47530 - DNA, 12 bp, Artificial Sequence
  synthetic [barcode part2]
aatacatccgac

SEQ ID NO: 47531 - DNA, 12 bp, Artificial Sequence
  synthetic [barcode part2]
ccattagatgtg

SEQ ID NO: 47532 - DNA, 12 bp, Artificial Sequence
  synthetic [barcode part2]
attcacgtggcg

SEQ ID NO: 47533 - DNA, 12 bp, Artificial Sequence
  synthetic [barcode part2]
acacgcagaagt

SEQ ID NO: 47534 - DNA, 12 bp, Artificial Sequence
  synthetic [barcode part2]
cgaatcacgtgc

SEQ ID NO: 47535 - DNA, 12 bp, Artificial Sequence
  synthetic [barcode part2]
acacttctgcgt

SEQ ID NO: 47536 - DNA, 12 bp, Artificial Sequence
  synthetic [barcode part2]
cttcgcatatgc

SEQ ID NO: 47537 - DNA, 12 bp, Artificial Sequence
  synthetic [barcode part2]
cgacacgactac

SEQ ID NO: 47538 - DNA, 12 bp, Artificial Sequence
  synthetic [barcode part2]
cagactacatac

SEQ ID NO: 47539 - DNA, 12 bp, Artificial Sequence
  synthetic [barcode part2]
ataagccgtcgc

SEQ ID NO: 47540 - DNA, 12 bp, Artificial Sequence
  synthetic [barcode part2]
cgcatcatcgga

SEQ ID NO: 47541 - DNA, 12 bp, Artificial Sequence
  synthetic [barcode part2]
cttatgtcgcac

SEQ ID NO: 47542 - DNA, 12 bp, Artificial Sequence
  synthetic [barcode part2]
ccgacatagtta

SEQ ID NO: 47543 - DNA, 12 bp, Artificial Sequence
  synthetic [barcode part2]
ccgaacttatga

SEQ ID NO: 47544 - DNA, 12 bp, Artificial Sequence
  synthetic [barcode part2]
aattctcgctgc

SEQ ID NO: 47545 - DNA, 12 bp, Artificial Sequence
  synthetic [barcode part2]
agtcttcgtcgt

SEQ ID NO: 47546 - DNA, 12 bp, Artificial Sequence
  synthetic [barcode part2]
atacgacggctc

SEQ ID NO: 47547 - DNA, 12 bp, Artificial Sequence
  synthetic [barcode part2]
ctagtgcgatta

SEQ ID NO: 47548 - DNA, 12 bp, Artificial Sequence
  synthetic [barcode part2]
atagtcgttgac

SEQ ID NO: 47549 - DNA, 12 bp, Artificial Sequence
  synthetic [barcode part2]
acgcgacaactc

SEQ ID NO: 47550 - DNA, 12 bp, Artificial Sequence
  synthetic [barcode part2]
aacatgtccgat

SEQ ID NO: 47551 - DNA, 12 bp, Artificial Sequence
  synthetic [barcode part2]
aatccgatgcgc

SEQ ID NO: 47552 - DNA, 12 bp, Artificial Sequence
  synthetic [barcode part2]
acatagtccgat

SEQ ID NO: 47553 - DNA, 12 bp, Artificial Sequence
  synthetic [barcode part2]
atcgccagtata

SEQ ID NO: 47554 - DNA, 12 bp, Artificial Sequence
  synthetic [barcode part2]
catcgcactcta

SEQ ID NO: 47555 - DNA, 12 bp, Artificial Sequence
  synthetic [barcode part2]
actcacgcgaca

SEQ ID NO: 47556 - DNA, 12 bp, Artificial Sequence
  synthetic [barcode part2]
cgaatgtattgc

SEQ ID NO: 47557 - DNA, 12 bp, Artificial Sequence
  synthetic [barcode part2]
cgagtgccaatc

SEQ ID NO: 47558 - DNA, 12 bp, Artificial Sequence
  synthetic [barcode part2]
cgtccgatagtg

SEQ ID NO: 47559 - DNA, 12 bp, Artificial Sequence
  synthetic [barcode part2]
cgttctcgtatg

SEQ ID NO: 47560 - DNA, 12 bp, Artificial Sequence
  synthetic [barcode part2]
cacgattcgacg

SEQ ID NO: 47561 - DNA, 12 bp, Artificial Sequence
  synthetic [barcode part2]
cggcaatcgcat

SEQ ID NO: 47562 - DNA, 8 bp, Artificial Sequence
  synthetic [i5 index primer]
agtcagct

SEQ ID NO: 47563 - DNA, 8 bp, Artificial Sequence
  synthetic [i5 index primer]
atgtgtat

SEQ ID NO: 47564 - DNA, 8 bp, Artificial Sequence
  synthetic [i5 index primer]
ccagttag

SEQ ID NO: 47565 - DNA, 8 bp, Artificial Sequence
  synthetic [i5 index primer]
tcttctcc

SEQ ID NO: 47566 - DNA, 8 bp, Artificial Sequence
  synthetic [i5 index primer]
ctatagta

SEQ ID NO: 47567 - DNA, 8 bp, Artificial Sequence
  synthetic [i5 index primer]
gtgcatac

SEQ ID NO: 47568 - DNA, 8 bp, Artificial Sequence
  synthetic [i5 index primer]
atgacgct

SEQ ID NO: 47569 - DNA, 8 bp, Artificial Sequence
  synthetic [i5 index primer]
tcaactaa

SEQ ID NO: 47570 - DNA, 8 bp, Artificial Sequence
  synthetic [i5 index primer]
acggcacc

SEQ ID NO: 47571 - DNA, 8 bp, Artificial Sequence
  synthetic [i5 index primer]
aagaggag

SEQ ID NO: 47572 - DNA, 8 bp, Artificial Sequence
  synthetic [i5 index primer]
ctcaaggt

SEQ ID NO: 47573 - DNA, 8 bp, Artificial Sequence
  synthetic [i5 index primer]
agcgctgc

SEQ ID NO: 47574 - DNA, 8 bp, Artificial Sequence
  synthetic [i5 index primer]
gtctcaag

SEQ ID NO: 47575 - DNA, 8 bp, Artificial Sequence
  synthetic [i5 index primer]
tcgtagtg

SEQ ID NO: 47576 - DNA, 8 bp, Artificial Sequence
  synthetic [i5 index primer]
accagccg

SEQ ID NO: 47577 - DNA, 8 bp, Artificial Sequence
  synthetic [i5 index primer]
gcagtatc

SEQ ID NO: 47578 - DNA, 8 bp, Artificial Sequence
  synthetic [i5 index primer]
tgcatacg

SEQ ID NO: 47579 - DNA, 8 bp, Artificial Sequence
  synthetic [i5 index primer]
cgcatgta

SEQ ID NO: 47580 - DNA, 8 bp, Artificial Sequence
  synthetic [i5 index primer]
taactggc

SEQ ID NO: 47581 - DNA, 8 bp, Artificial Sequence
  synthetic [i5 index primer]
cgaccagc

SEQ ID NO: 47582 - DNA, 8 bp, Artificial Sequence
  synthetic [i5 index primer]
tggtcggc

SEQ ID NO: 47583 - DNA, 8 bp, Artificial Sequence
  synthetic [i5 index primer]
tccgagat

SEQ ID NO: 47584 - DNA, 8 bp, Artificial Sequence
  synthetic [i5 index primer]
gaggagaa

SEQ ID NO: 47585 - DNA, 8 bp, Artificial Sequence
  synthetic [i5 index primer]
tcgatcag

SEQ ID NO: 47586 - DNA, 8 bp, Artificial Sequence
  synthetic [i5 index primer]
accttgag

SEQ ID NO: 47587 - DNA, 8 bp, Artificial Sequence
  synthetic [i5 index primer]
ggtgttac

SEQ ID NO: 47588 - DNA, 8 bp, Artificial Sequence
  synthetic [i5 index primer]
ctagctga

SEQ ID NO: 47589 - DNA, 8 bp, Artificial Sequence
  synthetic [i5 index primer]
tccttcct

SEQ ID NO: 47590 - DNA, 8 bp, Artificial Sequence
  synthetic [i5 index primer]
ggcattgt

SEQ ID NO: 47591 - DNA, 8 bp, Artificial Sequence
  synthetic [i5 index primer]
gctggtcg

SEQ ID NO: 47592 - DNA, 8 bp, Artificial Sequence
  synthetic [i5 index primer]
ccacaatg

SEQ ID NO: 47593 - DNA, 8 bp, Artificial Sequence
  synthetic [i5 index primer]
caaggtct

SEQ ID NO: 47594 - DNA, 8 bp, Artificial Sequence
  synthetic [i5 index primer]
tactgcga

SEQ ID NO: 47595 - DNA, 8 bp, Artificial Sequence
  synthetic [i5 index primer]
tgtcacga

SEQ ID NO: 47596 - DNA, 8 bp, Artificial Sequence
  synthetic [i5 index primer]
atatacac

SEQ ID NO: 47597 - DNA, 8 bp, Artificial Sequence
  synthetic [i5 index primer]
gcatgtac

SEQ ID NO: 47598 - DNA, 8 bp, Artificial Sequence
  synthetic [i5 index primer]
acgtatgc

SEQ ID NO: 47599 - DNA, 8 bp, Artificial Sequence
  synthetic [i5 index primer]
ggagaaga

SEQ ID NO: 47600 - DNA, 8 bp, Artificial Sequence
  synthetic [i5 index primer]
cctcttct

SEQ ID NO: 47601 - DNA, 8 bp, Artificial Sequence
  synthetic [i5 index primer]
ccggccaa

SEQ ID NO: 47602 - DNA, 8 bp, Artificial Sequence
  synthetic [i5 index primer]
gatatcat

SEQ ID NO: 47603 - DNA, 8 bp, Artificial Sequence
  synthetic [i5 index primer]
tctaaggc

SEQ ID NO: 47604 - DNA, 8 bp, Artificial Sequence
  synthetic [i5 index primer]
aacgttat

SEQ ID NO: 47605 - DNA, 8 bp, Artificial Sequence
  synthetic [i5 index primer]
gtaatgtt

SEQ ID NO: 47606 - DNA, 21 bp, Artificial Sequence
  synthetic [well-barcode]
tagagtcatctgactgatcat

SEQ ID NO: 47607 - DNA, 21 bp, Artificial Sequence
  synthetic [well-barcode]
atcacactacagctacgtgct

SEQ ID NO: 47608 - DNA, 21 bp, Artificial Sequence
  synthetic [well-barcode]
tatagctacgtgatctagcgt

SEQ ID NO: 47609 - DNA, 21 bp, Artificial Sequence
  synthetic [well-barcode]
atcgctgtgatagcagtacat

SEQ ID NO: 47610 - DNA, 21 bp, Artificial Sequence
  synthetic [well-barcode]
acgactgacactgtgtcatat

SEQ ID NO: 47611 - DNA, 21 bp, Artificial Sequence
  synthetic [well-barcode]
acgcactgctatcgcatcagt

SEQ ID NO: 47612 - DNA, 21 bp, Artificial Sequence
  synthetic [well-barcode]
tacacgactagctagctgatc

SEQ ID NO: 47613 - DNA, 21 bp, Artificial Sequence
  synthetic [well-barcode]
agcatagtactgcacgtctat

SEQ ID NO: 47614 - DNA, 21 bp, Artificial Sequence
  synthetic [well-barcode]
tacactgtgtcagcacgagct

SEQ ID NO: 47615 - DNA, 21 bp, Artificial Sequence
  synthetic [well-barcode]
tatcacacgtagtgacatctc

SEQ ID NO: 47616 - DNA, 21 bp, Artificial Sequence
  synthetic [well-barcode]
acatacacgtgactcatagtc

SEQ ID NO: 47617 - DNA, 21 bp, Artificial Sequence
  synthetic [well-barcode]
agacgtgatacgacagcactc

SEQ ID NO: 47618 - DNA, 21 bp, Artificial Sequence
  synthetic [well-barcode]
atcagatagtacgcactacat

SEQ ID NO: 47619 - DNA, 21 bp, Artificial Sequence
  synthetic [well-barcode]
tagcatcagatcgctcatact

SEQ ID NO: 47620 - DNA, 21 bp, Artificial Sequence
  synthetic [well-barcode]
actagatcatcactgagacgt

SEQ ID NO: 47621 - DNA, 21 bp, Artificial Sequence
  synthetic [well-barcode]
agtcacagctcacgatcacat

SEQ ID NO: 47622 - DNA, 21 bp, Artificial Sequence
  synthetic [well-barcode]
acgagtgtacgtactgtgcgt

SEQ ID NO: 47623 - DNA, 21 bp, Artificial Sequence
  synthetic [well-barcode]
tagtctgtcatcacgacatat

SEQ ID NO: 47624 - DNA, 21 bp, Artificial Sequence
  synthetic [well-barcode]
acgatctgtatcgatctactc

SEQ ID NO: 47625 - DNA, 21 bp, Artificial Sequence
  synthetic [well-barcode]
tactgatcgatctgtctgagt

SEQ ID NO: 47626 - DNA, 21 bp, Artificial Sequence
  synthetic [well-barcode]
agctcatcacgcagtacacgt

SEQ ID NO: 47627 - DNA, 21 bp, Artificial Sequence
  synthetic [well-barcode]
actacgcactgctacgcactc

SEQ ID NO: 47628 - DNA, 21 bp, Artificial Sequence
  synthetic [well-barcode]
actgtacgtcgagagctgatc

SEQ ID NO: 47629 - DNA, 21 bp, Artificial Sequence
  synthetic [well-barcode]
atagtcgactagctgtcgcat

SEQ ID NO: 47630 - DNA, 21 bp, Artificial Sequence
  synthetic [well-barcode]
acgatcgcacatcacacacgt

SEQ ID NO: 47631 - DNA, 21 bp, Artificial Sequence
  synthetic [well-barcode]
tatacgtcgatcatacgtgtc

SEQ ID NO: 47632 - DNA, 21 bp, Artificial Sequence
  synthetic [well-barcode]
tatagactgcactagctagct

SEQ ID NO: 47633 - DNA, 21 bp, Artificial Sequence
  synthetic [well-barcode]
agcagatacgcacactcgcat

SEQ ID NO: 47634 - DNA, 21 bp, Artificial Sequence
  synthetic [well-barcode]
atctcgctgtctgacagacat

SEQ ID NO: 47635 - DNA, 21 bp, Artificial Sequence
  synthetic [well-barcode]
acatcatcgctagagcagatc

SEQ ID NO: 47636 - DNA, 21 bp, Artificial Sequence
  synthetic [well-barcode]
agactgagtacacgtacgagt

SEQ ID NO: 47637 - DNA, 21 bp, Artificial Sequence
  synthetic [well-barcode]
atcatagtgtctgtgtagagt

SEQ ID NO: 47638 - DNA, 21 bp, Artificial Sequence
  synthetic [well-barcode]
tatagcgtgtcgcagatagtc

SEQ ID NO: 47639 - DNA, 21 bp, Artificial Sequence
  synthetic [well-barcode]
acgcagtgtgtagtacgtact

SEQ ID NO: 47640 - DNA, 21 bp, Artificial Sequence
  synthetic [well-barcode]
acgtacatagacgagtgagat

SEQ ID NO: 47641 - DNA, 21 bp, Artificial Sequence
  synthetic [well-barcode]
acgtgatcagagactgtagtc

SEQ ID NO: 47642 - DNA, 21 bp, Artificial Sequence
  synthetic [well-barcode]
agatacatacatagcgagtgt

SEQ ID NO: 47643 - DNA, 21 bp, Artificial Sequence
  synthetic [well-barcode]
tagtgacgactcgacgatctc

SEQ ID NO: 47644 - DNA, 21 bp, Artificial Sequence
  synthetic [well-barcode]
acatcatcagcgagcgtgtgt

SEQ ID NO: 47645 - DNA, 21 bp, Artificial Sequence
  synthetic [well-barcode]
agatagctagctagagtgtct

SEQ ID NO: 47646 - DNA, 21 bp, Artificial Sequence
  synthetic [well-barcode]
acgtgtcagtgagagatacat

SEQ ID NO: 47647 - DNA, 21 bp, Artificial Sequence
  synthetic [well-barcode]
tatcgactgtagagacacagt

SEQ ID NO: 47648 - DNA, 21 bp, Artificial Sequence
  synthetic [well-barcode]
agtcagcagcagcgtatcatc

SEQ ID NO: 47649 - DNA, 21 bp, Artificial Sequence
  synthetic [well-barcode]
tagagcgtgtgacgtagctat

SEQ ID NO: 47650 - DNA, 21 bp, Artificial Sequence
  synthetic [well-barcode]
agcgagtctgcgatctgtcat

SEQ ID NO: 47651 - DNA, 21 bp, Artificial Sequence
  synthetic [well-barcode]
agtctacgagacacgagcgtc

SEQ ID NO: 47652 - DNA, 21 bp, Artificial Sequence
  synthetic [well-barcode]
atcagtcgcacatagcactat

SEQ ID NO: 47653 - DNA, 21 bp, Artificial Sequence
  synthetic [well-barcode]
acactatctagacgcagtact

SEQ ID NO: 47654 - DNA, 21 bp, Artificial Sequence
  synthetic [well-barcode]
tatagcgacgctgagacgatc

SEQ ID NO: 47655 - DNA, 21 bp, Artificial Sequence
  synthetic [well-barcode]
tagagacacgagcgatcacat

SEQ ID NO: 47656 - DNA, 21 bp, Artificial Sequence
  synthetic [well-barcode]
atatctacgtatcagcagact

SEQ ID NO: 47657 - DNA, 21 bp, Artificial Sequence
  synthetic [well-barcode]
agtacacgactcatcagctgt

SEQ ID NO: 47658 - DNA, 21 bp, Artificial Sequence
  synthetic [well-barcode]
atctagtacgtgcgtacgtat

SEQ ID NO: 47659 - DNA, 21 bp, Artificial Sequence
  synthetic [well-barcode]
tactgacgtgtctcagagctc

SEQ ID NO: 47660 - DNA, 21 bp, Artificial Sequence
  synthetic [well-barcode]
agctatcatcacgtgtcatct

SEQ ID NO: 47661 - DNA, 21 bp, Artificial Sequence
  synthetic [well-barcode]
agtgctcatacatctgcacgt

SEQ ID NO: 47662 - DNA, 21 bp, Artificial Sequence
  synthetic [well-barcode]
tatctacgagtgtgatcgctc

SEQ ID NO: 47663 - DNA, 21 bp, Artificial Sequence
  synthetic [well-barcode]
agtgtcagcacagcactgcat

SEQ ID NO: 47664 - DNA, 21 bp, Artificial Sequence
  synthetic [well-barcode]
acgcactgactcacgagtgat

SEQ ID NO: 47665 - DNA, 21 bp, Artificial Sequence
  synthetic [well-barcode]
atacgctcgcagatctacgat

SEQ ID NO: 47666 - DNA, 21 bp, Artificial Sequence
  synthetic [well-barcode]
atcacgacgcagtagatagat

SEQ ID NO: 47667 - DNA, 21 bp, Artificial Sequence
  synthetic [well-barcode]
tactgtcgactcacatacgat

SEQ ID NO: 47668 - DNA, 21 bp, Artificial Sequence
  synthetic [well-barcode]
agagtacgtactgtagtgact

SEQ ID NO: 47669 - DNA, 21 bp, Artificial Sequence
  synthetic [well-barcode]
agtgagctgcacacactagtc

SEQ ID NO: 47670 - DNA, 21 bp, Artificial Sequence
  synthetic [well-barcode]
atagatacgcatagcgtacgt

SEQ ID NO: 47671 - DNA, 21 bp, Artificial Sequence
  synthetic [well-barcode]
agactgctgtgagactacgtc

SEQ ID NO: 47672 - DNA, 21 bp, Artificial Sequence
  synthetic [well-barcode]
atcacacagtcgacactgtct

SEQ ID NO: 47673 - DNA, 21 bp, Artificial Sequence
  synthetic [well-barcode]
tacatactgcagcgtgatcat

SEQ ID NO: 47674 - DNA, 21 bp, Artificial Sequence
  synthetic [well-barcode]
agatacgagtgcgactgctgt

SEQ ID NO: 47675 - DNA, 21 bp, Artificial Sequence
  synthetic [well-barcode]
acagactcatactagcgtgat

SEQ ID NO: 47676 - DNA, 21 bp, Artificial Sequence
  synthetic [well-barcode]
tacgcagagtgtcacagtatc

SEQ ID NO: 47677 - DNA, 21 bp, Artificial Sequence
  synthetic [well-barcode]
tagtgcgagtacgcagtcatc

SEQ ID NO: 47678 - DNA, 21 bp, Artificial Sequence
  synthetic [well-barcode]
actgtcactgcgacacagagt

SEQ ID NO: 47679 - DNA, 21 bp, Artificial Sequence
  synthetic [well-barcode]
actactcatagctcgacatat

SEQ ID NO: 47680 - DNA, 21 bp, Artificial Sequence
  synthetic [well-barcode]
agactcacagcagagcgtact

SEQ ID NO: 47681 - DNA, 21 bp, Artificial Sequence
  synthetic [well-barcode]
agtctacgtgcgtctcagtgt

SEQ ID NO: 47682 - DNA, 21 bp, Artificial Sequence
  synthetic [well-barcode]
agatcagagatcgctgcgtct

SEQ ID NO: 47683 - DNA, 21 bp, Artificial Sequence
  synthetic [well-barcode]
tacgtcacgacgtcagacgat

SEQ ID NO: 47684 - DNA, 21 bp, Artificial Sequence
  synthetic [well-barcode]
agacagcacactacacacatc

SEQ ID NO: 47685 - DNA, 21 bp, Artificial Sequence
  synthetic [well-barcode]
tagcgtagacacacgtcgatc

SEQ ID NO: 47686 - DNA, 21 bp, Artificial Sequence
  synthetic [well-barcode]
tagcagcagacacgtgcgtat

SEQ ID NO: 47687 - DNA, 21 bp, Artificial Sequence
  synthetic [well-barcode]
tagtcgactgtactagagtgt

SEQ ID NO: 47688 - DNA, 21 bp, Artificial Sequence
  synthetic [well-barcode]
atacatcagagtctgtagcat

SEQ ID NO: 47689 - DNA, 21 bp, Artificial Sequence
  synthetic [well-barcode]
acagtctgagcagatacgtat

SEQ ID NO: 47690 - DNA, 21 bp, Artificial Sequence
  synthetic [well-barcode]
tagagctgtctcatcagcgtc

SEQ ID NO: 47691 - DNA, 21 bp, Artificial Sequence
  synthetic [well-barcode]
actatcatcgctcatcgcact

SEQ ID NO: 47692 - DNA, 21 bp, Artificial Sequence
  synthetic [well-barcode]
atctacgacgctatcatacgt

SEQ ID NO: 47693 - DNA, 21 bp, Artificial Sequence
  synthetic [well-barcode]
tacgcagctcactagtgagtc

SEQ ID NO: 47694 - DNA, 21 bp, Artificial Sequence
  synthetic [well-barcode]
atacgctcatacgtagtgctc

SEQ ID NO: 47695 - DNA, 21 bp, Artificial Sequence
  synthetic [well-barcode]
acatacgtacgcagtcgcatc

SEQ ID NO: 47696 - DNA, 21 bp, Artificial Sequence
  synthetic [well-barcode]
tactgcgagagctacagacat

SEQ ID NO: 47697 - DNA, 21 bp, Artificial Sequence
  synthetic [well-barcode]
acgctatcagactatcacgct

SEQ ID NO: 47698 - DNA, 21 bp, Artificial Sequence
  synthetic [well-barcode]
atatcgctgagcacgactgct

SEQ ID NO: 47699 - DNA, 21 bp, Artificial Sequence
  synthetic [well-barcode]
agctgcagagtcatcgcatct

SEQ ID NO: 47700 - DNA, 21 bp, Artificial Sequence
  synthetic [well-barcode]
acacgagcgtgtgtacagagt

SEQ ID NO: 47701 - DNA, 21 bp, Artificial Sequence
  synthetic [well-barcode]
actgtgtacatctcatcgagt

SEQ ID NO: 47702 - DNA, 21 bp, Artificial Sequence
  synthetic [well-barcode]
atcatagagatacagcagtgt

SEQ ID NO: 47703 - DNA, 21 bp, Artificial Sequence
  synthetic [well-barcode]
tatctgacatacgactgtctc

SEQ ID NO: 47704 - DNA, 21 bp, Artificial Sequence
  synthetic [well-barcode]
agcgagtatcatagcacgact

SEQ ID NO: 47705 - DNA, 21 bp, Artificial Sequence
  synthetic [well-barcode]
acagacgctcgctgagcatat

SEQ ID NO: 47706 - DNA, 21 bp, Artificial Sequence
  synthetic [well-barcode]
agtgacagactgagcatacgt

SEQ ID NO: 47707 - DNA, 21 bp, Artificial Sequence
  synthetic [well-barcode]
tacgatctgagacactgatat

SEQ ID NO: 47708 - DNA, 21 bp, Artificial Sequence
  synthetic [well-barcode]
tactcactagactagacacgt

SEQ ID NO: 47709 - DNA, 21 bp, Artificial Sequence
  synthetic [well-barcode]
atagcatagcacgtacatctc

SEQ ID NO: 47710 - DNA, 21 bp, Artificial Sequence
  synthetic [well-barcode]
tacacgtcagtgcgacagatc

SEQ ID NO: 47711 - DNA, 21 bp, Artificial Sequence
  synthetic [well-barcode]
tatacgagtgtgagagtgcat

SEQ ID NO: 47712 - DNA, 39 bp, Artificial Sequence
  synthetic [plate-barcode]
atcagctacacgtgctgtcacgaccggtgctcgatttag

SEQ ID NO: 47713 - DNA, 39 bp, Artificial Sequence
  synthetic [plate-barcode]
tcgcagagtgatcgatatcacgaccggtgctcgatttag

SEQ ID NO: 47714 - DNA, 39 bp, Artificial Sequence
  synthetic [plate-barcode]
gatacgagagagtgcatacacgaccggtgctcgatttag

SEQ ID NO: 47715 - DNA, 39 bp, Artificial Sequence
  synthetic [plate-barcode]
tctcgcactagacatctacacgaccggtgctcgatttag

SEQ ID NO: 47716 - DNA, 39 bp, Artificial Sequence
  synthetic [plate-barcode]
gtgtgcgagtcacgcatacacgaccggtgctcgatttag

SEQ ID NO: 47717 - DNA, 39 bp, Artificial Sequence
  synthetic [plate-barcode]
tctgagctgtctactcatcacgaccggtgctcgatttag

SEQ ID NO: 47718 - DNA, 39 bp, Artificial Sequence
  synthetic [plate-barcode]
atacgctactcatacgctcacgaccggtgctcgatttag

SEQ ID NO: 47719 - DNA, 39 bp, Artificial Sequence
  synthetic [plate-barcode]
agatcgctcagacgtagtcacgaccggtgctcgatttag
